United States Patent 11,446,398 (REGULATED BIOCIRCUIT SYSTEMS) - sequence listing, part 45

SEQ ID NO: 134391 - DNA, 3244 bp, Homo sapiens
  Payload ID: 6254
  Gene Symbol: FGFR2
  Gene Name: fibroblast growth factor receptor 2
  Uniprot ID: P21802
  ENST ID: ENST00000369060
  CDS Start-End: 488-2605
ccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaa

SEQ ID NO: 134392 - DNA, 3803 bp, Homo sapiens
  Payload ID: 6254
  Gene Symbol: FGFR2
  Gene Name: fibroblast growth factor receptor 2
  Uniprot ID: P21802
  ENST ID: ENST00000369061
  CDS Start-End: 151-2280
tgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 134393 - DNA, 1138 bp, Homo sapiens
  Payload ID: 6254
  Gene Symbol: FGFR2
  Gene Name: fibroblast growth factor receptor 2
  ENST ID: ENST00000429361
  CDS Start-End: 1-1116
ttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaat

SEQ ID NO: 134394 - DNA, 3061 bp, Homo sapiens
  Payload ID: 6254
  Gene Symbol: FGFR2
  Gene Name: fibroblast growth factor receptor 2
  Uniprot ID: P21802
  ENST ID: ENST00000457416
  CDS Start-End: 593-3061
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatga

SEQ ID NO: 134395 - DNA, 3990 bp, Homo sapiens
  Payload ID: 6254
  Gene Symbol: FGFR2
  Gene Name: fibroblast growth factor receptor 2
  ENST ID: ENST00000478859
  CDS Start-End: 716-2497
acagactctcccgcagaactgaccccagcaagaagcctttgggagcagtagagatggagtttcactatgttgcccaggctagccttgaactcctgacctcagatgatctgcccgcgcaggcctcccgaagtgctgggattacaggcatgagccaccgcacctggcctgccaactcttgttaagatctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacctcgctgattgagaagacttcactctctctgcaaagagacgtgtgtgttttagaggaagtgggagccccagccgattctgcaagacttccgagagtcagatatccagacagaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacagctctttggcgttgctaagagactgccattttggaggaaagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaaga

SEQ ID NO: 134396 - DNA, 3501 bp, Homo sapiens
  Payload ID: 6254
  Gene Symbol: FGFR2
  Gene Name: fibroblast growth factor receptor 2
  ENST ID: ENST00000604236
  CDS Start-End: 603-1358
ggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatat

SEQ ID NO: 134397 - DNA, 579 bp, Homo sapiens
  Payload ID: 6254
  Gene Symbol: FGFR2
  Gene Name: fibroblast growth factor receptor 2
  ENST ID: ENST00000613324
  CDS Start-End: 1-409
gtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcaca

SEQ ID NO: 134398 - DNA, 4369 bp, Homo sapiens
  Payload ID: 6254
  Gene Symbol: FGFR2
  Gene Name: fibroblast growth factor receptor 2
  ENST ID: ENST00000613048
  CDS Start-End: 648-2846
ggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttattttttt

SEQ ID NO: 134399 - DNA, 435 bp, Homo sapiens
  Payload ID: 6254
  Gene Symbol: FGFR2
  Gene Name: fibroblast growth factor receptor 2
  ENST ID: ENST00000611527
  CDS Start-End: 71-265
aggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcaca

SEQ ID NO: 134400 - DNA, 3733 bp, Homo sapiens
  Payload ID: 6255
  Gene Symbol: FGFR3
  Gene Name: fibroblast growth factor receptor 3
  Uniprot ID: P22607
  ENST ID: ENST00000352904
  CDS Start-End: 40-2124
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 134401 - DNA, 4132 bp, Homo sapiens
  Payload ID: 6255
  Gene Symbol: FGFR3
  Gene Name: fibroblast growth factor receptor 3
  Uniprot ID: P22607
  ENST ID: ENST00000260795
  CDS Start-End: 103-2523
tctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 134402 - DNA, 4293 bp, Homo sapiens
  Payload ID: 6255
  Gene Symbol: FGFR3
  Gene Name: fibroblast growth factor receptor 3
  Uniprot ID: P22607
  ENST ID: ENST00000340107
  CDS Start-End: 257-2683
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 134403 - DNA, 3951 bp, Homo sapiens
  Payload ID: 6255
  Gene Symbol: FGFR3
  Gene Name: fibroblast growth factor receptor 3
  Uniprot ID: P22607
  ENST ID: ENST00000412135
  CDS Start-End: 257-2341
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 134404 - DNA, 4287 bp, Homo sapiens
  Payload ID: 6255
  Gene Symbol: FGFR3
  Gene Name: fibroblast growth factor receptor 3
  Uniprot ID: P22607
  ENST ID: ENST00000440486
  CDS Start-End: 257-2677
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 134405 - DNA, 4217 bp, Homo sapiens
  Payload ID: 6255
  Gene Symbol: FGFR3
  Gene Name: fibroblast growth factor receptor 3
  ENST ID: ENST00000481110
  CDS Start-End: 262-2640
gcggcgtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgct

SEQ ID NO: 134406 - DNA, 336 bp, Homo sapiens
  Payload ID: 6255
  Gene Symbol: FGFR3
  Gene Name: fibroblast growth factor receptor 3
  ENST ID: ENST00000507588
  CDS Start-End: 1-336
aaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaagacggcgggcgctaacaccaccgacaaggagctagaggttctctccttg

SEQ ID NO: 134407 - DNA, 4438 bp, Homo sapiens
  Payload ID: 6255
  Gene Symbol: FGFR3
  Gene Name: fibroblast growth factor receptor 3
  ENST ID: ENST00000613647
  CDS Start-End: 257-1351
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 134408 - DNA, 3122 bp, Homo sapiens
  Payload ID: 6256
  Gene Symbol: FGFR4
  Gene Name: fibroblast growth factor receptor 4
  Uniprot ID: P22455
  ENST ID: ENST00000292408
  CDS Start-End: 246-2654
cgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtc

SEQ ID NO: 134409 - DNA, 2418 bp, Homo sapiens
  Payload ID: 6256
  Gene Symbol: FGFR4
  Gene Name: fibroblast growth factor receptor 4
  Uniprot ID: P22455
  ENST ID: ENST00000393637
  CDS Start-End: 37-2325
agtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatg

SEQ ID NO: 134410 - DNA, 2733 bp, Homo sapiens
  Payload ID: 6256
  Gene Symbol: FGFR4
  Gene Name: fibroblast growth factor receptor 4
  ENST ID: ENST00000393648
  CDS Start-End: 183-2387
gtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccagttctccctggagtcaggctcttccggcaagtcaagctcatccctggtacgaggcgtgcgtctctcctccagcggccccgccttgctcgccggcctcgctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctg

SEQ ID NO: 134411 - DNA, 713 bp, Homo sapiens
  Payload ID: 6256
  Gene Symbol: FGFR4
  Gene Name: fibroblast growth factor receptor 4
  ENST ID: ENST00000430285
  CDS Start-End: 28-246
tgggtccctgagagctgtgagaaggagatgcggctgctgctggccctgttgggggtcctgctgagtgtgcctgggcctccagtcttgtccctggaggcctctgaggaagtggagcttgcaagcattcatctatcactgtgtctgcgagagaggactggccttgcagggcgcagggccctaagctgggctgcagagctggtgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcgg

SEQ ID NO: 134412 - DNA, 594 bp, Homo sapiens
  Payload ID: 6256
  Gene Symbol: FGFR4
  Gene Name: fibroblast growth factor receptor 4
  ENST ID: ENST00000513166
  CDS Start-End: 271-594
tcttcgcgccggcggcagagatgagggacctgaggccccgaaaagttcagtcacttagtgcccgggggcctccagcgcgagtgcgggaggctgaaggagaacccaggactgtctgatgcctaaggcaggccctccattcccacgtggggggtggtcggtcagcggtcagcagccatgggtgactcgactaaggactctgatatcagggcagcctggggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatc

SEQ ID NO: 134413 - DNA, 838 bp, Homo sapiens
  Payload ID: 6256
  Gene Symbol: FGFR4
  Gene Name: fibroblast growth factor receptor 4
  ENST ID: ENST00000511076
  CDS Start-End: 1-838
caggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaac

SEQ ID NO: 134414 - DNA, 770 bp, Homo sapiens
  Payload ID: 6256
  Gene Symbol: FGFR4
  Gene Name: fibroblast growth factor receptor 4
  ENST ID: ENST00000503708
  CDS Start-End: 168-770
gtcgcgggtacattcctcgctcccggccgaggagcgctcgggctgtctgcggaccctgccgcgtgcaggggtcgcggccggctggagctgggagtgaggcggcggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcgg

SEQ ID NO: 134415 - DNA, 2638 bp, Homo sapiens
  Payload ID: 6256
  Gene Symbol: FGFR4
  Gene Name: fibroblast growth factor receptor 4
  Uniprot ID: P22455
  ENST ID: ENST00000502906
  CDS Start-End: 174-2582
acattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctca

SEQ ID NO: 134416 - DNA, 552 bp, Homo sapiens
  Payload ID: 6256
  Gene Symbol: FGFR4
  Gene Name: fibroblast growth factor receptor 4
  ENST ID: ENST00000514472
  CDS Start-End: 210-552
acattcctcgctcccggccgaggagcgctcgggctgtctgcggaccctgccgcgtgcaggggtcgcggccggctggagctgggagtgaggcggcggaggagccaggtgaggaggagccaggtgagcaggaccctgtgctgggcgcggagtcacgcaggctcgagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcacct

SEQ ID NO: 134417 - DNA, 709 bp, Homo sapiens
  Payload ID: 6256
  Gene Symbol: FGFR4
  Gene Name: fibroblast growth factor receptor 4
  ENST ID: ENST00000510911
  CDS Start-End: 448-709
attcctcgctcccggccgaggagcgctcgggctgtctgcggaccctgccgcgtgcaggggtcgcggccggctggagctgggagtgaggcggcggaggagccaggtgaggaggagccagagacggggtttcaccgtgttagccaggatgttctcgatctcctgacctcgtgatccgcccacctcggcctcccaaagtgctgggattacaggtgtgaaccatcgcgcccagccgacttgtagttttttaaaactctgctggaagatgaaggttgaagagccgagggagaggatgtttccagaggcccatgcaagagatggccatgacctgccttgagaaggggcaggggaagccagatggactggaagtggagtggcagtgaccaaggaggaggaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagaga

SEQ ID NO: 134418 - DNA, 6550 bp, Homo sapiens
  Payload ID: 6257
  Gene Symbol: FRS2
  Gene Name: fibroblast growth factor receptor substrate 2
  Uniprot ID: Q8WU20
  ENST ID: ENST00000397997
  CDS Start-End: 190-1716
tcttcctatagatacgtaccaagattaacaatgactccaggatagagttatgaccaacactactaaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcggatatctactt

SEQ ID NO: 134419 - DNA, 521 bp, Homo sapiens
  Payload ID: 6257
  Gene Symbol: FRS2
  Gene Name: fibroblast growth factor receptor substrate 2
  ENST ID: ENST00000547414
  CDS Start-End: 428-521
ttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctaggtcattaatgtggatgatgatgggaatgagttaggttctggcataatggaacttacagacacagaactgattttatacacccgcaaacgtgactcagtaaaatggcactacctctgcctgcgacgctatggctatgact

SEQ ID NO: 134420 - DNA, 6600 bp, Homo sapiens
  Payload ID: 6257
  Gene Symbol: FRS2
  Gene Name: fibroblast growth factor receptor substrate 2
  Uniprot ID: Q8WU20
  ENST ID: ENST00000550389
  CDS Start-End: 247-1773
gaggccttgtaggcacagcggctgagactcgatctgctccaagtaggggctccagcgcgggtcggagtctgggggttcgcgcccgccgacccgcgccctgctccctctcagcacctgggcggacggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaagcattgtgttgtttgcacctttgtgaagtttttaaaaatgaagatgcaagtgcttcattttcatttctaaacactaactccttttatagactgataaaatttttttctgaatatttcatgtgcatctttaactaaagggaattaatgtagagcaggtactccttaaagaacactaatttcattatatactactcgttgtacagcagcattcccgttttcacagtgcctatttaaaatgagagttgaagtaaatgacatgctggttgatttttatcaatattctggacttaacgcatacctttcatgtctaagtcatggttggcttttaaaactttttataaagcctcttgacaatgtacattgctaacaggtaactataggctttgaaagtaatgctcgtagattcagtgttcacagtatgtggcctccagcatgtaacatgaggaatcctttatttcattaattaatggctttttgacttgagccaaaacatatgtaaaggaaacagaagtaccgcacctcctcttacaccagtcagctcctttgccttcagtgttactagaaagcggcctgtgtccatgagtgtgctttgctgttggtgcactgaaaggcaggaaggagacaagattttctatttactcatctcatgatgtcatttgaagggcatgtccagatatcttaaaattataataggctcaagaatcagtctcaggtcactttacccaaaaacatttgaaaatctgaaccacaatctcctgaaagtttttctcctatagattgttgacaacacattgttttctggaggcatttgtgccattaggtttccatttatcttcagtttttttctttggtgtttgggatgtcttattttgttgccttatgtccttttcaatttaaaatgtttgagtttgtatatagttttgaaattggattatgtgttcattgttgtttagtttgcatttttgtcaaattatggttttgaaggttcatttggaacttactgttagtctgtaacagggttgcccttgtccagtatttatttataagctgtttacttttcaagttgataaaaacattctccaattctaaatttgcttgtgtccataggtgatctctttagcaaactgagaaaaaaaggaagctacttttaacatgcaaagttccctcaaggtgtaccgtgttgtctctgtgggcactcttccccagcactttagcagtaattcccccagctacacgctgcagttgtactctgcccactctagtgttcctcagctctgctgtccttttacttgtagctggatctttgattatccttcgatttccatgaaatattaatattgttgccagcatagcaggtacagtggaagtcttgtagcagtgagattgtatcataatttaggatttaaaatgaattaaagtttatataaactgaagagtctccatatgtcaaactcttggaaaatcaaagatgttccaatttcctaaacactagagaatacgagagaaggtagagtggaaaaggttaggtaaccttgcaaaatattttactattttctctaaatatgaggaagtttgagattatgatctggatctaccagatataactaaggttaatttagcatgaaaaagttttagtcatattggcatccaacctattcagtaaccgaatcataggacaatgatggattaggagaacaatagagtgggatcattataaagaaaataaattattaaaggtgtctttatcgttttagtgccatttttagtgtctttactataaatcaatatcagtgtattttatcattctatgtgcatagcagaattttcttttctcccttttgttcccctgtgaacttggtgcttattaaagtgctcactgttctcttaaaagagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttctaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataagtagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcggata

SEQ ID NO: 134421 - DNA, 611 bp, Homo sapiens
  Payload ID: 6257
  Gene Symbol: FRS2
  Gene Name: fibroblast growth factor receptor substrate 2
  ENST ID: ENST00000547219
  CDS Start-End: 504-611
aaaacccttccctcccccgctcccccggaagtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgctcctggcaaccactatttgagtttctgcctctacaaatttgactattctaggtacttcataaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggc

SEQ ID NO: 134422 - DNA, 781 bp, Homo sapiens
  Payload ID: 6257
  Gene Symbol: FRS2
  Gene Name: fibroblast growth factor receptor substrate 2
  ENST ID: ENST00000550937
  CDS Start-End: 509-781
ggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaagatacgtaccaagattaacaatgactccaggatagagttatgaccaacactactaaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgt

SEQ ID NO: 134423 - DNA, 570 bp, Homo sapiens
  Payload ID: 6257
  Gene Symbol: FRS2
  Gene Name: fibroblast growth factor receptor substrate 2
  ENST ID: ENST00000550169
  CDS Start-End: 540-570
tcgatctgctccaagtaggggctccagcgcgggtcggagtctgggggttcgcgcccgccgacccgcgccctgctccctctcagcacctgggcggacggtacccaggctgaagtgcagtgtcacaatcatagctcaccacggtcttgaactcctgggctcaagcgatcattctgactcagcctcccaagtaggtaggaccacaggtgtacagaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaag

SEQ ID NO: 134424 - DNA, 597 bp, Homo sapiens
  Payload ID: 6257
  Gene Symbol: FRS2
  Gene Name: fibroblast growth factor receptor substrate 2
  ENST ID: ENST00000548154
  CDS Start-End: 477-597
ttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggagattttcttctttctaccatcatcaagatcaagcaggcaagtttacttgctgtcatcttctgcaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaactta

SEQ ID NO: 134425 - DNA, 584 bp, Homo sapiens
  Payload ID: 6257
  Gene Symbol: FRS2
  Gene Name: fibroblast growth factor receptor substrate 2
  ENST ID: ENST00000549092
  CDS Start-End: 486-584
acagcggctgagactcgatctgctccaagtaggggctccagcgcgggtcggagtctgggggttcgcgcccgccgacccgcgccctgctccctctcagcacctgggcggacggtacccaggctgaagtgcagtgtcacaatcatagctcaccacggtcttgaactcctgggctcaagcgatcattctgactcagcctcccaagtaggtaggaccacaggtgtacagaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagtta

SEQ ID NO: 134426 - DNA, 704 bp, Homo sapiens
  Payload ID: 6257
  Gene Symbol: FRS2
  Gene Name: fibroblast growth factor receptor substrate 2
  ENST ID: ENST00000551325
  CDS Start-End: 154-704
agaaattctcaatgtttttcttctgtttttaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacaca

SEQ ID NO: 134427 - DNA, 545 bp, Homo sapiens
  Payload ID: 6257
  Gene Symbol: FRS2
  Gene Name: fibroblast growth factor receptor substrate 2
  ENST ID: ENST00000550316
  CDS Start-End: 510-545
agtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgattgaaggtttgtggcaaccctgtattcagaattctgtatcagtgccatttttccagccagcgtgtgcttacttcatgtctctgggtcacattttgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacact

SEQ ID NO: 134428 - DNA, 1952 bp, Homo sapiens
  Payload ID: 6257
  Gene Symbol: FRS2
  Gene Name: fibroblast growth factor receptor substrate 2
  Uniprot ID: Q8WU20
  ENST ID: ENST00000549921
  CDS Start-End: 417-1943
ggaagtgcttttccaagattcgggccggagagaggccttgtaggcacagcggctgagactcgatctgctccaagtaggggctccagcgcgggtcggagtctgggggttcgcgcccgccgacccgcgccctgctccctctcagcacctgggcggacgaaatgaccattaagaagtagatgcccagatgcaaaagtgatgaaacagtccatttgtcataaagtaagatgcagctgtggcatgtcaaccagcttggaacaaaattgtatctgtttttctcagaagagaattccacaaggttaaatcagcaaacaaagaaaacatggtattttgaaatatgattaaactcctgatgctgcagcagaggctaagaatattaatggccagatctagtgcacacatggtcttctgaagaagccatgggtagctgttgtagctgtccagataaagacactgtcccagataaccatcggaacaagtttaaggtcattaatgtggatgatgatgggaatgagttaggttctggcataatggaacttacagacacagaactgattttatacacccgcaaacgtgactcagtaaaatggcactacctctgcctgcgacgctatggctatgactcgaatctcttttcttttgaaagtggtcgaaggtgtcaaactggacaaggaatctttgcctttaagtgtgcccgtgcagaagaattatttaacatgttgcaagagattatgcaaaataatagtataaatgtggtggaagagccagttgtagaaagaaataatcatcagacagaattggaagtccctagaacacctcgaacacctacaactccaggatttgctgctcagaacttacctaatggatatccccgatatccctcatttggagatgcttcatcccatccgtcaagcagacatccttctgtgggaagtgctcgcctgccttcagtaggggaagaatctacacatcctttgcttgtggctgaggaacaagtacatacctatgtcaacactacaggtgtgcaagaagagcggaaaaaccgcacaagtgtgcatgttccattggaggcgagggtttctaacgctgaaagcagcacaccaaaagaagaaccaagtagtattgaggacagggatcctcagattcttcttgaacctgaaggagtcaaatttgttttagggccaacccctgttcaaaagcagttaatggaaaaagagaaactggagcaacttggaagagatcaagttagtggaagtggagcaaataacacagaatgggacactggctatgacagtgatgaacgaagagatgcaccctctgttaacaaactggtgtatgaaaatataaatgggctatctatccctagtgcctcaggggtcaggagaggtcgtctgacatccaccagtacctcagatacccagaatatcaacaactcagctcagagaagaactgcattattaaactatgaaaatctaccatctttgcctcctgtttgggaagcccgcaagctaagtagggatgaagatgacaatttaggaccaaagaccccatctctaaatggctaccataataatctagatccaatgcataactatgtaaatacagagaatgtaacagtgccagcaagtgctcacaaaatagaatattcaaggcgtcgggactgtacaccaacagtctttaactttgatatcagacgcccaagtttagaacacaggcagcttaattacatacaggttgacttggaaggtggcagtgactctgacaaccctcagactccaaaaacgcctacaactccccttccacaaacccctaccaggcgcacagagctgtatgccgtgatagacatcgagagaactgctgctatgtcaaatttgcagaaagcactgccacgagatgatggtacatctaggaaaactagacacaatagtactgatctgcccatgtgagcctggaaa

SEQ ID NO: 134429 - DNA, 2094 bp, Homo sapiens
  Payload ID: 6258
  Gene Symbol: FRS3
  Gene Name: fibroblast growth factor receptor substrate 3
  Uniprot ID: O43559
  ENST ID: ENST00000259748
  CDS Start-End: 173-1651
gctaggtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtagggacttcccggtcctcaccaccctctgccccaccatgatccagcctctgcctcacactcctgtcctctgaacccaccctccccagggttcagggttgctttgcagaaggcatggaggtgggaccagatgcttccctgtgctggctggagtccccagagatatcagccaccgagtctcctggtctgtctccaggctggggagagaagggtgaccaggcgaggagggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctg

SEQ ID NO: 134430 - DNA, 2174 bp, Homo sapiens
  Payload ID: 6258
  Gene Symbol: FRS3
  Gene Name: fibroblast growth factor receptor substrate 3
  Uniprot ID: O43559
  ENST ID: ENST00000373018
  CDS Start-End: 253-1731
ggggaggccttagctccgggcgggcggcggctgctgcagcgggacccgggagcggggcccggcgccgcccgggccgcggggcgatgtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtagggacttcccggtcctcaccaccctctgccccaccatgatccagcctctgcctcacactcctgtcctctgaacccaccctccccagggttcagggttgctttgcagaaggcatggaggtgggaccagatgcttccctgtgctggctggagtccccagagatatcagccaccgagtctcctggtctgtctccaggctggggagagaagggtgaccaggcgaggagggagccgagacgtcaactgtgaagggttcctgtgattgcgtttagcgccctcccgttctgtccatttgtcttgtctgccgactgtccgtgtgtgttttttttggttggaattttgaaacattttgtacctgttgattttatttatcagtttatttttctatttattgttttaaatgtaatttaacatatttattattaatataattatttttaaattctg

SEQ ID NO: 134431 - DNA, 474 bp, Homo sapiens
  Payload ID: 6258
  Gene Symbol: FRS3
  Gene Name: fibroblast growth factor receptor substrate 3
  ENST ID: ENST00000426290
  CDS Start-End: 34-474
cgcgtttacgctgggttttcaaccattcgctgaatggaaacgcctcgccgggcccgcagccctgtctctccgcagttcccagggcaggctggctgctctgacaccatggggagctgctgcagctgcctgaacagagacagcgttccagacaaccaccccaccaagttcaaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagc

SEQ ID NO: 134432 - DNA, 326 bp, Homo sapiens
  Payload ID: 6258
  Gene Symbol: FRS3
  Gene Name: fibroblast growth factor receptor substrate 3
  ENST ID: ENST00000422888
  CDS Start-End: 218-326
cgcggggtgggttcgggcggcccttggaacgctccggccagggatgcgcggtgagccccaggtgtatcccagagggatccgggtgacttctctgcagactgtttgccatgacagcccaccaaggacggggggaataaagtgggaacccttccccatgcccctcccacggtcagctccccgatggcctgggtgagggcaggctggctgctctgacaccatggggagctgctgcagctgcctgaacagagacagcgttccagacaaccaccccaccaagttcaaggtgacaaatgtggatgatgagggggtggagctgggctctgggg

SEQ ID NO: 134433 - DNA, 3100 bp, Homo sapiens
  Payload ID: 6259
  Gene Symbol: FGFRL1
  Gene Name: fibroblast growth factor receptor-like 1
  Uniprot ID: Q8N441
  ENST ID: ENST00000264748
  CDS Start-End: 36-1550
gcgcccccaatgtccccaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcc

SEQ ID NO: 134434 - DNA, 3639 bp, Homo sapiens
  Payload ID: 6259
  Gene Symbol: FGFRL1
  Gene Name: fibroblast growth factor receptor-like 1
  Uniprot ID: Q8N441
  ENST ID: ENST00000398484
  CDS Start-End: 581-2095
actttgcacgctcgcagccacgtttccgcacacctgtcccctttccacgcacctgtgtccggcagcccgcacatctgtgggagcgctgcctcctcgccagctgtccgggaagttcagcgccgctctcccacgggcgtgagaccgccccacccacctgtccgtgactgcagctccggccgggagggcggcagcaggtgagaggctgggaggcctcaggtgggaacatacctttggccaaaggcaccaggtaacccgaacgccccggggaggacccctgcctgcatcgccgcggccgtccccccctaccccgtccccagcagctccggctgggcgaggccctgcttctcccttctgctcccgaagaccccccggggcgcagacctggaagcctcgaagctcccgcggccgtccagtccgcccccttctgagcaaccagagagcggtctgggcccggcccggggctgcgcagaggtcagactgccgcgggcagggccggagcctgctctgggggtcgcggaggtgtctcgagagttgaggacccgacccgggcgcgcgcgggcgcaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatccttt

SEQ ID NO: 134435 - DNA, 1663 bp, Homo sapiens
  Payload ID: 6259
  Gene Symbol: FGFRL1
  Gene Name: fibroblast growth factor receptor-like 1
  Uniprot ID: Q8N441
  ENST ID: ENST00000504138
  CDS Start-End: 149-1663
aaatttgtccgctaatggcgcaggcgattatctgcggggcgctgagtgttgtgtgtcctgcgggcagggccggagttacaagcgccaggaatccagacggtgtttggagagggggggcggcgggggagcccggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctag

SEQ ID NO: 134436 - DNA, 562 bp, Homo sapiens
  Payload ID: 6259
  Gene Symbol: FGFRL1
  Gene Name: fibroblast growth factor receptor-like 1
  ENST ID: ENST00000507339
  CDS Start-End: 106-562
gctaatggcgcaggcgattatctgcggggcgctgagtgttgtgtgtcctgcgggcagggccggagttacaagcgccaggaatccagacggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccct

SEQ ID NO: 134437 - DNA, 2304 bp, Homo sapiens
  Payload ID: 6259
  Gene Symbol: FGFRL1
  Gene Name: fibroblast growth factor receptor-like 1
  Uniprot ID: Q8N441
  ENST ID: ENST00000510644
  CDS Start-End: 150-1664
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacac

SEQ ID NO: 134438 - DNA, 571 bp, Homo sapiens
  Payload ID: 6259
  Gene Symbol: FGFRL1
  Gene Name: fibroblast growth factor receptor-like 1
  ENST ID: ENST00000512174
  CDS Start-End: 332-571
cgctaatggcgcaggcgattatctgcggggcgctgagtgttgtgtgtcctgcgggcagggccggagttacaagcgccaggaatccagacggtgtttggagagggggggcggcgggggagcccggtaattagtgtaaaccctttgtctgcctttgatacccacagcttctccccgctgcggcttcctccgcctggagcgcgggcggggagggcctgtggggagggcggccagacccctgatccccgcggcccgggaccggggagggcggtatctcccagttccacgtgttagtgacggcgcccccaatgtccccaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctg

SEQ ID NO: 134439 - DNA, 3310 bp, Homo sapiens
  Payload ID: 6260
  Gene Symbol: FMOD
  Gene Name: fibromodulin
  Uniprot ID: Q06828
  ENST ID: ENST00000354955
  CDS Start-End: 465-1595
ttaagatgtctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 134440 - DNA, 8708 bp, Homo sapiens
  Payload ID: 6261
  Gene Symbol: FN1
  Gene Name: fibronectin 1
  Uniprot ID: P02751
  ENST ID: ENST00000323926
  CDS Start-End: 267-7607
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 134441 - DNA, 8435 bp, Homo sapiens
  Payload ID: 6261
  Gene Symbol: FN1
  Gene Name: fibronectin 1
  Uniprot ID: P02751
  ENST ID: ENST00000336916
  CDS Start-End: 267-7334
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 134442 - DNA, 8905 bp, Homo sapiens
  Payload ID: 6261
  Gene Symbol: FN1
  Gene Name: fibronectin 1
  Uniprot ID: P02751
  ENST ID: ENST00000354785
  CDS Start-End: 371-7804
cggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 134443 - DNA, 7846 bp, Homo sapiens
  Payload ID: 6261
  Gene Symbol: FN1
  Gene Name: fibronectin 1
  Uniprot ID: P02751
  ENST ID: ENST00000356005
  CDS Start-End: 267-7157
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 134444 - DNA, 7898 bp, Homo sapiens
  Payload ID: 6261
  Gene Symbol: FN1
  Gene Name: fibronectin 1
  Uniprot ID: P02751
  ENST ID: ENST00000357867
  CDS Start-End: 267-6797
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 134445 - DNA, 8524 bp, Homo sapiens
  Payload ID: 6261
  Gene Symbol: FN1
  Gene Name: fibronectin 1
  Uniprot ID: P02751
  ENST ID: ENST00000359671
  CDS Start-End: 267-7427
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 134446 - DNA, 723 bp, Homo sapiens
  Payload ID: 6261
  Gene Symbol: FN1
  Gene Name: fibronectin 1
  ENST ID: ENST00000438981
  CDS Start-End: 1-723
tacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacag

SEQ ID NO: 134447 - DNA, 8103 bp, Homo sapiens
  Payload ID: 6261
  Gene Symbol: FN1
  Gene Name: fibronectin 1
  Uniprot ID: P02751
  ENST ID: ENST00000421182
  CDS Start-End: 266-6988
cccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagta

SEQ ID NO: 134448 - DNA, 2388 bp, Homo sapiens
  Payload ID: 6261
  Gene Symbol: FN1
  Gene Name: fibronectin 1
  Uniprot ID: P02751
  ENST ID: ENST00000426059
  CDS Start-End: 272-2245
cggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactga

SEQ ID NO: 134449 - DNA, 7759 bp, Homo sapiens
  Payload ID: 6261
  Gene Symbol: FN1
  Gene Name: fibronectin 1
  Uniprot ID: P02751
  ENST ID: ENST00000432072
  CDS Start-End: 266-7069
cccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 134450 - DNA, 7952 bp, Homo sapiens
  Payload ID: 6261
  Gene Symbol: FN1
  Gene Name: fibronectin 1
  Uniprot ID: P02751
  ENST ID: ENST00000446046
  CDS Start-End: 267-7259
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaa

SEQ ID NO: 134451 - DNA, 7762 bp, Homo sapiens
  Payload ID: 6261
  Gene Symbol: FN1
  Gene Name: fibronectin 1
  Uniprot ID: P02751
  ENST ID: ENST00000443816
  CDS Start-End: 272-7069
cggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaa

SEQ ID NO: 134452 - DNA, 3720 bp, Homo sapiens
  Payload ID: 6261
  Gene Symbol: FN1
  Gene Name: fibronectin 1
  ENST ID: ENST00000456923
  CDS Start-End: 1-3312
ctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactg

SEQ ID NO: 134453 - DNA, 3949 bp, Homo sapiens
  Payload ID: 6262
  Gene Symbol: FLRT1
  Gene Name: fibronectin leucine rich transmembrane protein 1
  Uniprot ID: Q9NZU1
  ENST ID: ENST00000246841
  CDS Start-End: 1044-3068
tggcaggtgaggaagcaggcagtgggcgagaagatggattcctttttggacagacaagaccagagagtgaagcgggaataactcatcctccctacctccccagcaaggaaacctctacaaacaggagcagccaagcaggactgaggcccttgccccccaagcatcttctcaaagaagggcatgtgggggcctgacagctcagctgcatgtgtcagcagctccagccccaccatgaacatctgaactcctcagcggggtaatggaccccctcctttcccccggagacacagcctgagtggcaggaatacagagcctttggagagtggctccctctcagctccgtcatgcaagaacactctctgcacccagcccattctgccaagtgacttaaaggaattaaaaaaaaaaaaagccttggtaaacaaaaagggggtaaaagccacgcagaggcccttcagaagaggtggcgggctgcagacaaaagggcaagagttgaaaagggctgtggaggtagcaagcagcagaggccaccctgctcagggctgggtgccaggccacagggcatgcccgacgaacagggagtcggaaccccctcaggccaccctcgggagtcctggggtccagaggggtgtccctgtaccccttgcacacaggaccctcactctgcagggataagccagctgcgcctgcagcctagggtgccaaggaggctgctgattgtggcccacagcctcatctgaacgccaggagaccaggataccgaggcaccggatcccctctctgtgccctggggagccccagtgctgcccagtcaccccagggctgaggtctgcgtccctagtggtgcaaggcctggtaggaccacggggcagggaatgtgagcgccatctgagctcacggtgtcctgagtcgcggcttcgtgactttggcaggggcctccggaccagtgaccccagtcaaacccagagggtcttgggcggcagcgacgaaggaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgatgccaccaccctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattaccagcgagatggacgagtgttttgagacggggccgcagggcggcgtggccaatgcggctgccaagaccacggccagcaaccacgcctctgccaccacgccccagggttccctgtttaccctcaaggccaaaaggccagggctgcgcctccccgactccaacattgactaccccatggccacgggtgatggcgccaagaccctggccatccacgtgaaggccctgacggcagactccatccgcatcacgtggaaggccacgctccccgcctcctctttccggctcagttggctgcgcctgggccacagcccagccgtgggctccatcacggagaccttggtgcagggggacaagacagagtacctgctgacagccctggagcccaagtccacctacatcatctgcatggtcaccatggagaccagcaatgcctacgtagctgatgagacacccgtgtgtgccaaggcagagacagccgacagctatggccctaccaccacactcaaccaggagcagaacgctggccccatggcgagcctgcccctggcgggcatcatcggcggggcagtggctctggtcttcctcttcctggtcctgggggccatctgctggtacgtgcaccaggctggcgagctgctgacccgggagagggcctacaaccggggcagcaggaaaaaggatgactatatggagtcagggaccaagaaggataactccatcctggaaatccgcggccctgggctgcagatgctgcccatcaacccgtaccgcgccaaagaagagtacgtggtccacactatcttcccctccaacggcagcagcctctgcaaggccacacacaccattggctacggcaccacgcggggctaccgggacggcggcatccccgacatagactactcctacacatgatgcccgcccacccgggctgccccgcctcagccccagctgccctggcgtggccatgtggctttgcccagcctgctgcaatccaagagagcaaggaagagaaattccatgggtgactttcctccgcagaaagcaaagtttggggagggctgacgattttgtagaacacaacagtgacaattttttttaaaagaatagaaggcaggagggggaattcgacattgttgaagacataatttataccaagttatgccagttggggagggaaggactaaaaataatattgcaggcagggctgggttgggttttttttttttcccccctgaactggaaggatactacctgtacaacatctgtggacacctcatgctctgttcaaggccatcacaaaggaaccgccagggagaagcagccggctctcaaagctcccacgcagctctcccgccactggccactcgctggcgacccgatggaaggttttcaggctcctcacaaaggagagagggaagaaaagatcttttgccctggagatatggtcctgaaatctctcccctggcttattccataccatttcccttgcagatttgcagaaacatggcatctttcactgcattctttgaacaatcatgtagtcgattaaaaaaaaaaaacaaacttttttttcctaggctgaagccctcttcagttccatgcaccacgctccgtagaagccccggcggaagccgtagctttccctgccacctggaggtgcatctgtctgcctgtctatccctgtcgcggtgtctctaagtacagatgggtagatagagccacatgcacggtccttaccgttcttcttgggtcagttcttaccatttcctgaacaatagaattgtgaaagtgtt

SEQ ID NO: 134454 - DNA, 32767 bp, Homo sapiens
  Payload ID: 6263
  Gene Symbol: FLRT2
  Gene Name: fibronectin leucine rich transmembrane protein 2
  Uniprot ID: O43155
  ENST ID: ENST00000330753
  CDS Start-End: 768-2750
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccgtgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattttagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaccacattgtgtttatctgagtaagttcattgggatacagtcaatacttgtgctgttaatgtagaagaaatgacgcaggagggcaggaataaaagaggtaataggactttcgtattctcctatcatgaatatgacttgcatttctaaaggccatttgatcctttttgtgtgaggagtttatatgaaatcctcatgttcttttaaatttcccaactaaattgtgtgttcctacgaataccttttaggtatgcacacatacacagagcatcttattttatactggtgaaatctatgttgtttaggatacagataatgtcattgtatttatcctatcagaataggcttttcccctatttcaaaatagatgctattggctttattttttatttttaaattttttttaaacacggtcttaccatgttgcccaggctggtctcaaactcctagatgcaagcaatcatcccacctcgatcacccaaagtgctgggagtacaggcagaggacaccatgcccagccacgctattggttttaaatgtcagatttctttaagaattctcatagtacttttctgccgcagaatttatagcacatctgtccatcctttcaataggcactcaaggaaatgtatctattcatatgctcaacttcaattgattagtctcatatgatttttcagaaccccttttgctaacccctcttggccatttcattaataatgtatttgacagagattgaatcaggaaataaattcatgacatttcagttaactagtattacctgtttgtagaatctctgttggaacattgactatgaaagacagtgctaacaagtaattcatattacttttggggattttatgtaaagtaacatctatgctattcttgggtacttttgccaagagttacagaccttattctatacagactaaaccattagtcaaaaaataccattcattcaaaataattcattaatgtcctcctactctgttccaaacactaggctgagttcagaggcctcacagaatagtgaaatgcgttcttagccaaatcaggcaaatcttctccctcactatgtccctgaagaaatctcttcatctgatatatttactattcatctactttctacagcactatgttagggtcttccggggattcagagaaaagtgtctgtgagccattaagaaactcacagatcaggtaataaacactttttctaatgcattccagtgtctcagagcctgcataatcactttatactacttcattaaattgacaggacatctaaggtgacaaaagagatgtttctacctgttggtaaggttgatgcaactgtcataattagatgttcttggtttttaatagatgcagcaatgagagagtacattgctaaagtcagaacttaatttgaattaaattttcaagtttccaccaagtatttgaaaacttagaaattgtatttcgtaattacacatgcagacatttaaatttttattaagcaccacgatggaactcaatctaaaggaataatggcacctgataattactaacaacctttgtttatataagaccttgtgcaaactgtgtgataacgtatgtttgcattctgtctttaaaataaccctgtaaggtgcgttattttaatttttagattttaaaacttagcttcaagagaaattaagtgattagtctatagctacaaatcctgtaaatggcagagtcaggaattaccactgagcatgactccatggactcttaattgttttcctgcctcttaataaattgaccatccttgagactgactagccttcagatttttcatgatggagctatcataacttctcagtggatacatatattatcatttatggcaaataaagggaacattttagaagcctcaaaattcttgtcttttaaagcccttggtcatccattcctattttttataaaaattctttttgtgattatttgatggctgcacatttatctgatttgaaggtttcagatggaatcaagatatgtctgtacccatagggtgagctgaaagagctactaaaaggtcttcagttgggttatttttaggaatgaatttgtttcgtacttgagatgttgctctaagtattttgtagattccgctgaaaaagcacgtatgtcacaatctattagggcattagtaaactggcttctgaatttatgctctttttttttcccataacatagataaaaatgtgtgctttaggggatattatataagctttattttcactggctctactgaaagttaaggatacaaaagtttttaatggtaataacccaaactatatgtcattttagcacacacataccaatgggtgatcatatctgtcttttttttttttttttttttttggtatgaagtctaaactagacgaaaacctcaatatatccttaggggaattcttattacttcaatgacataataaacctcagtattgggtcactcttttcctaatataaaaaactatgctggctcaaaaagtcttctaaactccctagttgggataggatgggcctttgttggtttagttttgatttcattcagcaaatatttaccgaggcctggtaagttctggtgcagaataagaatgttttccaggagagttaaattttgctcatcaaaaatctttcttggaagctgctggtttttaaccgtcagcctgggctctttctgcctctttgctttttttgagcagaatatggccaggctggtctcaaactcctgatcttaggtgatccacccacctaggcctcccaaagtgctgggattacaggcatgagccacaccactgcatttaaataatcagcctaggattctgctagttccagcaccagagtggcctctcaaatgtgttttctcctcttggttccctgactctgacttggttaagacccttcctttagtctttttctaatttagcctttccaacacattgaaggacaaagggtaatcataatctataaggaatgcctgagtacgatactgcagtgcttgcaaaacatgcgtttttattgcttgcaagatagaattcaaactctttgtgtgacttatgtatcctactacatgttgctccctgacatttcttaccaatattgcctcctccttcattacatgctctagattatatatatataattacatatataatctagattttatatatatatatatatgaaatgagcaaacaaaatgctttcagtttatcttcctgggatctcaagttccttcaaaccactatatatgtgctcaaggtctttcatcctgtgacattcccctttgcctgatgacatatttgtcctttaagatacaagtcaaagacctctcttccaaagccgctggaatcacacctgccaattatctgaccgctttgtgcggttaatataactttaaaatacatttatttttagcacctatatattgtaattttttgtgagtctgcttcatgcctatacaatggggcccctggaaacagaaaacatattctgtaaattgttgtacctcatccagtgttaagagccatgcccaggccctggtgggtgcccagctacaggggaagagccactctgtcagttgcttatggccagatggctctttttttaatagccccagaaagagctgtggagttctgacttgtgcaaaattagccttgctcaaagaccacagtatgcgttttacaagaacaaacaaacatatatattttccttaaaatctcttgattactcatcaacatttttaaaagaaattttgtttttatgattatttggtggccatgcatctgatttgaaagctttagatggaatcagtatgtctacattcataggatgtgctgagataacaattaaaaagacctgaagaacatctttttattttatttatttatttttttttgagttggagtctcactctgtcaccagattggagtgcagtggcacaagctcggctcactgcaacctccgcctcccgggttcaagcaattctcctgcctcagcctcctgcgtagctgggactacaggcgtgcaccaccatgcctggctaattttttgtatttttagtagagatgggttttgccacattggccaggctagtctcgaactcctgacctcaggtgatccccccacctaggcctcccaaagtgctgggattacaggtgtgagccactgcgcccagccaagaacatcctttttatatattacagacaaactcaaaactgaaccagcttgcagaaaagcatacaaagaggtatctttaaaaatcaccttaatcccagcactttgggaggccgaggtgggcagatcacgaggtcaagaaatcaagaccatcctggccaacatggtgaaaccctgtctctactaaaaatacaaaaaatttagccgggcttggtggtgcgtgcctgtagtcccagctactcaggaggctgaggcaggagaattgcttgaacctaggaggtggaggttgcagtgagccaagatcatgccattgcactccagcctggtgacagagtgagactcaaaaaaaaaaaaaaaaaaatcaccttgcaacaaaatatcgccatcatgaaaagtccacaaagcacaagtagacacaaagttaaacatttcgacagtcggctagtcaaaatgaattctttgcatgtgaaaagcagagattttttttttttcatcttcatcagcaaaattaaaaaagacagtcattattcactatgtcatatcccatataaaaatacagcatatatcatttaaaggttcacattgtgttatcttggttattgccatgagaatagtctttcctagaaatgatatgcttgtaaagaagggagtggagagtggtagttattaagaaatcagtttgaaatcaagctgacttactttggaatcctgcttcaaccactgacctgccaatttgccttggcaataacttgcactttagggttatcagtgtacttttcctaaaatggggacaatgatgtctaacacatatggtggttgtcagaattaaaggcatatatagtagttgacagagtatctggtactgagtatacattgaataaatgacatgaagcaccatgtatttttcatgcagatgtaattcacaagcacatggtgacaaattgccagctttttatgatgaaaatcaaatttcttgtgtattggggtaagaattacatgtagagatgatctatttaaaggtaattagcattcaaaattcctcaaaacactcaataatttgcacagctattatcaagatgggtctgtcagaaaggttttcattattctgtattctttctgggggaaaaaaattgggaagatgaggtgccatgggataacacacaaccatggcaggccttttttctcatggtgtgtgggatcattgaacaacatggttgaacagaaagagaacagacttctttataatgtagcatatattctatctggttgctagagtacacatagatgtagttattgctgaaaattaattcagaatatgtgggtgtcaaaagagccccaggaatgagcattcagaaggcattggaaatcaaaatactaaaaacaaaatcaagataagctgagcacagtggctcatgcctataatcgcagtactttgggaggccaaggtgggaggattgcttgaggtcaggatttccagaccagcctgggcaatgcagtgagaccctatctctaaaaaaaaaaaaaaaaattagccaggagtggtggcatgtgcctatagtcccagctacttgggaggttgaagcaggagggtcacttgagcccaggagatcaagattacattgagctctgattgtgccactgcactccagcttaggcaactgagcaagaccctgtctcaaaaaaaaaaaaaaagtaataaatttctgatattgtttcaaaaatctataatttctagtaagacatagttttatttgatgctagtacaccaccaattacggcatttaaatccacactgggtttgctgatagtggggatggtagcagtcaaatggaagaacattttaatgtctctacaatgcaggtgcaatagtctaccacctgtcatgtggttactttttgcaatcgatatcattattaagtttggaagctggttgttattaacaggcatgcatcctcttcagctggatcacgttgttttctttctgtacactttgtggtagttaatagtctcaaagcaattcactcactacggtctgtattagcattattttcctttctatttatgtctttccttgcttaataaatgcagaagttcagacatttgatgaggggggaaatatactttttcagtccttgactgcatgatttaattggtttcaggacagttatttggcaagtagtatcaatgggtactggcattcctgtggtctgctgccaatctctattctgtttggactagtgtctgttttgactggtaggcctcagctatcctattgctaagtattttacataactgccctcattagttggaatatagcatgctttactagtgtatctgaagtaaggaggaagcaggaagtgagctgttttgtaatggaggccaattatatctaacagcaactgtgtctataagactgtagcctattggatgggaagttatattatgaaaacatgatgaatcttttaaattctgagtccaatgctgtctacatctaaatttaaatcctggctcatactaaccttggtccttgggcatgtatatgcttcaattttctcatctgtacatgggttaataacaacactcacctcaacagtaaccatactgcacagtgcctgacacatataaagtgctcaataaatgccagctactttctgaaaatatatggaattagtgtgcaaaaagttgggctatataactcaaatctcctttgtatcttggataagaccacttctctctcgggcttgtttcttatagtcaaaagcgcaggaatttagttgatctcccaagttactttggaccttaaattctgttttatggttgttcattttctatgtagtttagatttggttcattggactgatttgtgttctgtgtgcttttaaaattcaggaagatgtgactaggatagataaagcaaacatataaacactcagtttcattgacttaagtataaagactaacatgtttctcattagttataataaccttaaacttgatatgttagggaagcaacctgcataaccattaaaatcaggagctacagaatcacaaagaactgtgactttgtatctgtgtgatattatttaatgtccctaagcctcagtttcctcatatatgaaatgaggtactaatacttttaaggatttgatgagataatttatatcatcttcacttcagtggttggcatatattcaaacccattatggctgaaaaattacaaatgaatagaaagagaagcaagtgaaaacaaaactcattagttcaaccacttctccctcaaaacaaggaaatacaaactatattactaagtagactattaataaaacactttatttaagtcaaaattatcaaagatagagtgtcgtacaataaaaattgtataaaaaattgtttattaaaatattaaatattttatgttttcaagccattatataacagctattaaaccctaatatttgacagagaaagaattatgagaatagctagaaaatattaaataataaatgtggtttatttttgatggaatagaacagattttaaccctgatccctgccacttttatctgaaccttgaacaaacatacaattatggtttaaaaaaaagaaagatgaaaactttttagaataattaggaaattcttctttcccagaccttcaatacttttataaaaccactacttagcagctaacaatgaaatgttcatttcaaaatgtttagtctttaaagcggttacctaagaatatctgccagtgaacactagctttatttcatcacatcatacacctgaatgtaatcaacattgctttattaaagatgtttatataatttttatataatacacacttccaataattgataatagtctaatgattgatattttaaattaatggcttgtaattgtgtaattggaaagtggtccttgggactcagattaaggtatcattacctgttctttcataagctgttatttatgcttctcattaattagttctttgttatgaaatctttaaaagttcattaattctgtaaagggaatttaataaaatgcaagcagattagtaaaataatttgttttaaagttagttttaaatattatgctacctctataaaggaccaaaatagtatttttaaaagaatttatcaaagtaactataataaaagtatttaatggtatttgtattgcaaacattgaaattctacctggcagtttaaagaacatcactaacattgcctaaatgtaggaaaatcaaaggtgaagtcacctgcagaaaaaaaaaaaaaaaaaacaaaaaacattcttattaatcttaactaattttctttagtgacagaaattcaaacttcgagacatgtttgaaacattttatttcagtaaatatagctgtcactatggaagtaattactctaaaggaaatctgttttaaaaagccagtataaactgaaaagtaagcaacaaaacatcttcaggaaaagaaaaagaaaggcaaataaaatgtttatatgaaattacgaacattctgggccgggtgtggtggctcatgcctgtaatcccagcacttttggaggctgaggtgggtgaattatttatttgaggtcaggagtttgagactagcttggccaacatggtgaaagcccgcctttactaaaaatacaaaaattagcagggtatggtggcaggcgcctgttatcccagctacttgggaggctgaggcagcagaattgcttgaacctgggaggcggaggttgcagtgagctgagatagtgccactgcattctagcctgggtgacagagcgatacttcgtctccaaaaaaaaaaaaaaaaaaaaaaaaagagagagactaacattctaacagacaaaacaaaaacaaaaaacaaaaaaacacattttacaaaacaataatctaagtgggcaagtaaatactggtgtgacatacatttttagggaaaaactagcaacatgttttgtggagataaatgtaaacacattttacacatacaaatcttttctggcatgggtacaaatgtaactaatcaagtgtaatttataaactataaaaaattttcatctagacaaagaagttattaaaagcattaacaagtagttgaaaatattatccctctaagtattagaaagttaaactgcagtaattaaaagtcatataagaatcaccatggcatagacatggtaggaaaagcattagctttggcgttcaaatattgactcattcacttaccagctgtgttctccagtcaaaaaacttcacctctttaatgtttggtttcatattttttaaaaggtataacaaaaacacctaccacagtgttggtgtgaagactcatttaaagttactagcacagtgtctagtatatacagttgctttgttacattaactccattcaatattctttctttccacaatcgtctgtcactcccggtagaactaagtgattttccatgctcctgcaatgacagcaaatttcccccagtctgctcttccatgaatatctcagacagagaagggtgccttctcatgtgatcaggagtgatgtagctttgagggtggacccaccattcctgccatattccttgggtaggctcatctatcacttgtcttaaaggaagatttgaaacataatagtttcctttgcgcttctgtggatgtctctgaaaaagctggcagggcacacactcttgcaaatttttcatgttgtaatcacccaccagtggtaataatagggttaattatatgaacccatatagtagtgtcatttaaagggaatttaaattctctcttgtccttactctgctccaccatcctccactgtgcttgaaatgcctatcattatccttattcttttgataccaggcatcactacaaaatgtatacacattacctagattttcaagaagtgaaatgtttagtaaccattatgatggaagctgggactaggtgacttattctaaatgtaacaattaccggtagagaatgggataaaggacaactgagtgtggatagagaaaggagaaatggaagagtttggagcacgggccattgcgatggacagacgccaccgcagagagcaaggtttacctgtgtggttggcattcttggaagtgctctggttctattggcagagatccttgctgttagcctcttgcctttcgcccaggctgaagacagagtgctttcccatggttctgtctttttctccaggcaacacttcctgatgactgatcaatattggggtaggaagtcttagacatcttactccagctcagatcagctctgatgggctgcaggctcagtttaggcttcccttgagatttcatcatggctttacttctccctctaccagtcctggttcttcatagccttccacaggtgtcagctgcaaaaaccctcccaagtaagcctcttgtatgctactctgtctcagagtccatttccttgggaacccaacctgctacagcctacttcacacttcttctcaaggctgtcttgaattcctccaacaatagacccgttattatgtgaaagtgtgaggctgggcccaagggatttctttacttattgagcagagcgaagtaacattaatttgtgttataaccactgaatgttctaattccatgaatttaaatgacgcacctgaacatatatgaggcctagattttgctgcatgtccgcaaacctattttgatcaaccagtactgaacttttccccttctcttatgattgtcaaataaccttgttatatgctaaaaataaaagattaaaaaacatacagtgcaaaaaagcaaacaaaagttagctaataatcaattctttgaacgaagcccagtgaaaccaagtttatcaactctatctgaaaataaaaatgtccaagaaaatgacaatcaaaacgattagtgcattaggataagtgtcgtctcttgtagatagataaaaactaaactgaaaccaaaagaatttccagagcaggcagtctctattctgtaacaaggttttctcatgatccagttattttaaggatacctgcaggatcccacaggttttctcagggatttgctggaagctgggaaagtgatgactctcattcactgttgccctgtttccttttccttgacaaattcagttaaccggatggcaagttgtttatgagcatgccttctcgttaagttgacaaaatcttgacaggagtaaaagataatcgaattctctttgtgaagtgatttatggttttaaaataagcagcttttcttgaaagtagtttaccgggttgggcaaaaagaggatgagtattaaaggtcattaggcattcaaggtaccacatttactttctacaatgcaagtagaagaaggggccccaccagtcattctgagacgtgtttccattttctgctactttttagtgagcccaaatgatggtagcaatgattgatttatctcaatcttcttgtatagctgctgaattttctctcatgagtttggctaaaattagagtgtgtgttagtagaatttatatttatagactattgatattattatgtgcattacccattttaaagatggaaacactgaagcccccagaaaggactggctaagctcttacaataagtgatggaatgagctttgaaaacacagggcttaggatttcaaatcaggctgttttccctcaccgcaccatggtgcttcactagcagaaattctttatttttttttttttcctttttttttttttttgagacagtgtctcgctctgtcccccaggccagagtgcagcggcgtgatctcgactcactgcaagctccgccttccgagttcacaccattctcctgcctcagtctcccgagtagctgggactacaggctcctgccaccacgcctggctaatattttgtatttttagtagagacgaggtttcaccgtgttagccaggatggtctcgatttcctgacctcgtgatccgcccgcctcggcctcccaaagtgctgggattacaggcgtgagccactgccccccacccactagcagaaattcttaacagttattgttatctaactacttgactagtgtagattctgctgtgagcttgtggtggttccttctgcagataaagcaaaggaaatctggaaatggccaacctgaatactttatttccaaaactgtatattttatcaggacagtaaggcaatcagtggagtaatgatccttccaaactgctgactacatctagaatcatgcaattattagtttttaataaagatcgtgaccaagctttccttgggaagtaaactttggtcaccacaatatacatagcaagtattaaatatcttgagaggttttctttaattgtttaattcataggaaagccactgggagccttctgggagccagaagcaaattaggagacacagaattatttaataataatggtaataatgactaagttctctcatcaaggtctgtaccatgattgaactacttgctgccataaattttttactattgaataaatatgctttgtgaatattccatacatttgctaagttctcactggtcaggttcagtctttgctattagagtcgagcatctctgcaaagagatttgagccccttgagtagaacataggccacatagtgtggcaaacacatcattagaaactgcctcctattcactctcttaatagcttgagagaattgtacacaaacgtttctaaaatacagatcctaccttaggcttttcggctgcacagctgaatcgcctctgtgaaaatcctgacctcgctttcttctggcctttcttccccgtgaccttgggcaagttgcttaaactgtagccataatttcctcatagatttggtatgagttaaaatgcatagaaagcatgtactacatctagtgcatttctccataatgtgggtggcaattattctaatcccttccacaaagtatttagtctatgacttatttctgcgaaaacccacgaaagtgaaaactaacaatagagaagccttttaaaaacctaacagcctccaaagactgaagaagagagcatggtgtttaatgccagggtggaaagctgtgacagtcagctttttccctggatatggcttattggtattcattattcccaattccttctatatgccttcctttctggatagaatcgatcacatttgctggactccattatgtttggattctatgtataaattaggttctaccaattacaggcacgtgtgcaggattttcaaggtagaagtgaagtggaaactctcttcttactaatgtcagtcttgggcccaagaggccatcaggcacggtgcccataatcagtgttttagtgtctggtcactatcttcagtggagtcaggtgatgtgaatagcagcaggagagacctgatttctggataaggactacagtagtacgtccttggacgcaacagtttaagaggtagttcctgatttattcccctcccctttccaattcattccctgattttgtgcacacctaatacttatattaaatacctctcctgctttgaataaatggaataatttctgtttcctgcattttatcttgttggattaagtatttgataataaaactgattgtgggtctacttacctaagggtataaatttgatattggttacctaaactgtctgaatttgaaagtagagacaatcttattcatgcataatggatcactgataatttttggcttgcaatgagaaaaaaaaatcagcagctgaaattattacctgagatcacctggaatgaagagcctattaaagccaaggctttggtgaccaatgtgattgcttcagaattttatgatgagaatgtaaatataataattgtgaggtaggctgaagcatgtatagaaagaaaacaacaaattcagagttttaaataactggctcaaggcaagtcagaggtccaaggagcatctatgattatctccgacactattttatttcttacagtttcaaggttgctgttgacaaaaaaaaaaaaaaagaaagaaagaaaaaaatggcacacagtgtctgatcttgtttattgctgaaatataatttcagttgaatcacaccctcatcaggtcttctctgtgaaaattagggcattgagtgagaaatatcagaaacccagagcattataatgggaatgttaggtaggtttaaattattctgactatactgaacccccaagtccgatgagccttctttgccagtagaactccttcatctctgttatataaggttgattctgcctttgtggggagaactaacttacctgaggtaactaatgtaaaatagcttgttctgatcacctcactgcctccaagtctagagttagagctcgttcccagtgtctcagtagggcttaaatatgaagtataaactgggaagaaaaggctaaaataacaacaaaaaaacggcaatagtttgttattttttatcaggagaaatctgcggactatgtatggcaacagactcaaagggaggtacaccaggtaggaaaaatcataaccagattgggccatattagccaatatgggtacatatactagagcctgcatgcaatgagcttacccaaccagctcagagtgattataattgttttgctttctggattggttgactgaaatctggactcaatggtgagtcacactaattgaagttgagatggaagaaattccttggcatattgtagaatctgaaatataggttgtatatttattagtcagtttggactgctgtaacaaaaataccatagactgagtggcttaaacaataaacatttattacttccaattcttgaggctgtgaagcccaagatcaagttgcctgcagatctggtgtctggtgatgctcctctttttgagttgtaaacaactgccctcagaaggctctctcctgtctctttttattaggtcattattctcaacatgagggctccacccttatggattaattgcctcccaaaggcctcatcttcaaacactattccactcggggctaggatgtcaacatatgaaatttaggggcacataaatatacagtccataacagggagataggaacattggagtaacccatcatatgattcactttaatgtctaaaaacatctcatgagagagttcagagggtatttcttttttttctttctttctttctttctttctttctttctttctttctttctttctttctttctttctttcttccttccttccttccttcctttctttcctttctcctttttcttttttttgttttgagacaggttctctctctgtcacccaggcaggaatgcagtggcgtgatctcagctcactgcaacctccgcctcctgggttcaagcgattctcctgcctcagcctcctgagtagctgggactacaggcgtgcaccaccacacctgactaatttttgtgtttttagtagagacggggtttcaccatattagccaggctgctctcaaactcctgacctcaggtgatccacccgcctcagcttcccaaatcgctgggtttacaggcgtgagccattgcacctggccagagggtgtttctttaaggcatttattaatgcattgatgaggactctcctcttttagatagagatgaaagtgtagatgctgcccacaaaatgtgctccctgtttaagtggggttggtggaatcctggagtgacagagaacaaacgacaacatttagtccagttgcagcagagtggttgtggtttttattataagcattaaaagtatagtagtaggaaactgtgtttaacctgttttcaagaatggataattgctcattatagcttcatgaataatatagatgttcagccaacttaagttgtacctgaattgtgcaaatgaaggaaagatgcaggtttggcaaattgaagccagactaattatcacaatgtagtatcattaacactcacacaattcccagattcaaggtgcagcagtggatatttctaagacgtcctcatttaacttgatttttttttttaatctatgaagtagttggctatgttttggagaatatacaattaatgtaagtttactcaggtggtaattccagttgctatggttgtggaagatatggtctctacttaaacaaattcaactgagctatggcatctccaatgcaactgtcaatttagaaatttctttctttttatctcaataggcaaagaacactaaagtagtctgctttcactttcattaacacgccccatggagatatcatgaattactctcaggcccttgattatcttatcataccagaggatgtcccacaggtctacagcttaataacatcatgtgactgaagtggaagaactggaaggaaaagataacctagaaactcagtaattcacatgcattcaagaaggtagaagaaaattctcactaaaactcagggacatgccaccttttgcaaatttctgggagtttagtccggcatgtctggaaatcctttccaaagaaactgggcctgttcttgatgggctccctggatgtttgaaggcaacatatactagttttagatgcgctgcttcgatactttggattcaatacttagtaatccctaaagctgtgaatttggagtttgttgctgaggaagagtagactctctagcttttccaggctgtggtccaggctgctgtctttgctacttggttacaatgatccagcaaattcaacggtgcataaaatgtttcaggcagatggtcatgcagtttgtaaaactttgccaatctcgtaggagattaatagcgtagagctctgtggttctgaagcaaaatcatgctttctttcttagattattaatctccttgtgagggacagttcttgtcttgctaatagaaatagatgccgaaagaggctcaactgttggctattggatcccgagtagtaatgcaactgaactgtaatcatgagttttgatcaaccaaccataaagttgagcttgggcagcagaactcctacatcaagtaaaaagtatatatatacacacatatgtgtgtatgtatatgtatacctatatatatgtatacatatgtatatatgtacacatgtgtatatatgtatatacatatatgtatacatgtgtatatatgtatacatgtgtatatatgtatatacatatatgtatatagaagtatatatacacatataaatgtgtgcgtgtatatatatatgattggctgagtgctctatttgttgcttgagcaggtgttcaccctcccacataaattcatcctacttaattggcactttttcttcaacccatacctgcttctcagagaaactatagagaagaggaaacttccaagtgagcaggtctttgaatggtacatctatttgttcactctgcttggaaacaaaggtttcactaagcatggatacaatttggatcattggtaataaggagacttagggaagaaatacgtgttaaggattgttcataagtggcagaacctatgagaatattcatgccacatgttatttcttttcagaagatcttcctagttgaggaatctttcagagattcagtagataaggtgatctattatatggatgtcaagctgtccttttccccagccaccctcctcacgtcttgctcaatgacttcatgaatgaaaagtttatgatagcaaagatgttggtaacatatgcattcaacaacatagttcatttggtagagtcaatactgagtacctaagagcccaattctgatactctcatattgcactattcactaggaggttcagcaatctatttagtggcaggtggtgacagtggatttcttctcttatggaaaggacaactatccatattgaaatagacaattactctgtatatagatttgcctgccttgtaaccatgcctttgcatctgtttacttacttaatgggacattattatggtgacccatacaacatcacttttaaacagtggatttatttatggcacagaggttaagaaaatgaactcaggccggtaagagtcactgttatcattcaccacaagttgcctgaagcaaccagcctttaaaatactataatggactgtggaaaaatcagttagagtgtcacttggatgaagctgtaattggaagttgaggacactgtcattcagaataagatgtatgatctgaattagtggccaatacctggccctttttgtctgtagttaaatgtgatgtgaggaaataccaaagctcatggtaatctcagatgtcattggacagagaagctcacagaccaaattaagatgctgaagtcagatgacttatgaatcaatttaaaacaaatcatgagaaggaagggaggaaaggatgaagtaggtttgcagtcctcttagaagaaggtaaaagtgggtagaatggaccatagtacttgaatcttgagttcagaatcagatattcttcctccttggcctcttctgtttcagggcttctcgaatttttttttcttttatttattttttgagatggagtcttgctctaccacccaggctggagtgcagtggcacaatcttggctcaatgcaacctccttctcccaggttcaaggaattctcctgccttagcctctcgagtagatgagattgcaggtgcccaccactacacccagctaatttttgttttttttggtagagatggggtttcaccatgttggccaggctggttctgcctcttgactttatcatccttcctctctgatggtatggttatgtggaccagaactgaagtttaaggaaggggcttaagatatggaagttgcctgggaccaacatactctgtccaagagacacagtgacacatacatgcacagctgaccaaagctatagcttcccaattacttgatgaacagctatgaatgttgtttctttttcttagacaaagtgcatatctgctcaagatggatgtcactaatgtgcaactgatccacaacctcatacaattttagtatctcatatgcttcgtgtacatgtcatgtatgaaggtgcctgaggtaccccatgtatatatagcatgttatgaatgttaggcatattttggtctttcctttctatctatgtttagtatgcacaagacatacttattttacctttgcttaatatgccttatagtttactaacttacttaacagaggagttttgttttcttgttatctgtagcagaattgaatgttgcccagcaatataatatatgtaaatcataccaaattatatgtgtttaaaactcaagggatggaactgggagagataacactcatttttcacctacgcatcactcacaatatttagctctccttccacatgatgttgggatatgatggcttagaagtcttactagtcaatggaagaatgtttctcttccaagaggacacaacaatgattcatttgaactctatgattgccactgaataatttggtctttccatgcctataagcaaagaagttacgtgtattaactggaacaattggtcctgattattaaggagagtaagtttttcctacaaagagatgtatgtatgggacccagggaattttacagaaacatctctaagaacttccatgcttttttgtcaagttaaatggacaactatcgcaaccacatacaggcagaaccactaagagtaaaaacccctcaggaattaggattcgggtcaccctgcttggcagagccctaattagtcacagtgctaggtgaggtcaaaagtaatatgaaataggaagaggataaacagtgtcataaacaactgtgatcttatggccagttgcagagtaagaaattaataactactcctgttctcttctttgccttgttatgcatgtactgactttttacctctttctttttccctacaattttataaaaatggtgatacatttgtaatttgtccctcaaattacagactatcagcttgaaactatgattggaattgaaggttaaagaaaacccagctatagattcagtgactaacaaaatttggggacagtgtaagcctcattctaattgcataaggaatagttactgtatgttaggcaggtgcatgttgttattgctacttttttcaagtctaagttctaggtacaaagtgtacactgtactggatttagtatttgacatctattttcacatccttctaggagtcatcttgtactaaagaagctgtaagcccacatgtgcatttcccagagtcccttgttgctagggggctgaatgcgaacgaggtttcaccattaaatatacttatacatttggaaaggcaaaaatgaggcagaggccatctttgtgttgctggtttgattagcaagtttgctaagacatgagtgtcaagggaagttgaggtggagatggtggctatatggtgcagctgttttcctgattcccagagagcaatcactcagatgtgctcttgtacttaatacttccactggcagtcccttttctttcctcttttagttcttcctataattttctaagtgtataattgcccattttccctaaatacctaggtaggttttatttcctaaactggacctcttaccaaacacagatgagatgtactgtctgccaccctaactgcccataggactccaccaaggatgccaactctaagtggtcatttacctctgtgattgtgtttttaatgcctgcctcccattaagttataagatccaggaatttaataatttattttgataaggacttaacacaatgcttggcacataagaggaattaaataacatttttctgaatgaatagattttaaaccatgtgtgagcagtcacagaattcactgatctattataatttaccaattcctttgcatcatagcacccatgcaaaatattttggctacagggagtgctccaattttgatactctccctgtcaatatgcctattaccccaatataatttaagattgacagggagagcatcagtattctgcagtctgattgcagaagcatatatgtaaaaatataccttttagaaatgattttagaatctggaaatttacaaactattaattttcttttctacagtttcctccagaaagcccctatgtatttattccggttaacaattttacttgagtagaaatcacttgactcaaattttgatgatttaatagctcattgaaagaactagcctgaagcagataaaatatgttgcagatgctgtaactcttatttgcatccattggtcttttggtttatgtgctttaataatttgaaaaacaagaagataatcaggaaccaagatggatatgtgtgtcttgaggcagaacttaattcaaaattgttcagtgttttgtcagatgaactccttaaccacatttgttatcagtagcacacaatatattggattaagtttttgaatgatgtgcaaagatgatgccagattgatcctaacaaacataaagctcagaatcaaaaccagaatgttgttttgatcatactggttttaggcaaaggattttaagataaattctttcatactggaatttgtgatactatccacacttttcctcactataaaatttaatgaaccttatatcattaatatttttgtgtcaatggtgagttcttcttttttctttacctgagttgtatcaacagtttcaaaggagagagagtgtttttggtaaaggcaataaattattttttaatgtacatcttatacacataaaatactttctcatattctgaagaatgaagcatttctgtcctaggtgattataaagtttgttgctatagtatttcattattttttattagaaaatattttaataacacaagaaagtaaagaaagtaatacaaggaacactcatgtacacatcaaccagctttgtctgaaattaatatcatcctaaatttgcttcattgcttttattcattaaaaattacaaatacaattgaagcccttgaacccctcacctgtcacactatcctctttgctttgtcaaatacttactacgttcatatgtattgatgtacagtatagccttattttacgtgttttaaatttatacataaacaatttcaaactctatgaatcattctacattttgctattttgtgttcaatatcctgttgtcgaaacatttccatgttcctttaattcattcattggcaatacagtataatatgttattgtatagatacatatatatttaaaatatataggtattttaattttactgtattatattgttgaacatttccactgttttacattttttagtatcataaactatccttcaatgaacactcttttaatgtcatctggtgtcaggtatgagagttcctaaacacacacagtgtatctagaatttgaattgctaaaattgaacattcaattttcatttttaactttactaaatactgtaaaattgttctctgtgtgccaattttctttaccactggtaaaatgtgagtttccactttcacatgcttgccatttcctattgcaaaacatttaagtatttatgtttgtgataaaaatggagtcttattttgattttaatttgtacttccccagttcctgttgtgtttaagtttgttttttatttatttattatctgttcatgattttcttcattttttctcttactggttcatattctctatacatgctgaatggtgttagctagctatattctttgcaataattattaaaattttctttttcttttctttttttaagagacaaggtcttaccctgtcatccaggctaggatgcagtagcacgatcttagcttactgtagactccaactcctgggctcaagagatactctcctgccttggtttcctaaagtgctgggattataggcctgagccactggcctgttttgtttttcttaatataaggctatacatttccctctaagaactaatttagctgcctccctcaatcttttatatgtaattttaagttaatattcagctttaaacttttctaattcaattatcttttttgattaatcaattgtttaggataatgtctcaaaacttttttggtatatagatatctttaattacatatttctaaattattttcatttaagtcaaaggacatagcctggaaagtattcgtttgtttgtgtgtgtgtgtgtgtgtgtgtgtgtgtatttgttgtgatttgtttttatgttttagcaatttggtcagttgctttaaattagagattttgcctgattgttatctacagaattctatgcaactccattacattaagctaatatcgcttcattttatctctcatcacattttgtttttgtttgtttgtgctgtgaattattgagataatgggttaaatgtatgtgcctgtgtccatttatttcaataatatcttatactatgactctatattattaattgggaagattttagaatacttaacgtatgttttctaattaagcagtgacccacttaatttctcagaagtacattttgttttattgctttaaactctattttgattgtttttaatctgatcatacagacttttattttggctgatattttcgttacttttttcttatttttatcctttctatgtctttatgattaaattgtgtgccttacaaggaggttttactttttccctcaatggatttggaagatatatgttctatttttatttctgttgttggtttcctgaaaatctcagcatgcatatttgacttaaattctaaaattaataaacactttcttaatttcctgaacaataaaaggaatttcaaacatattattggtcatcatcacctgcctattaaatatgctttcccactagggctggggctaatggaaaatacatcttaaaaagtcttctgtgtaaaacatgggactcaaaacaacactaggaaaatagcgtagatcagataattctcattaaatcagctgtttattaaaaaaagcaatgagcaaggaacaacaaagtctccttaggaggcaaaacaaagtattattaaaagtatgtttgatgttgctgaagattctttcataaacatattaaagtcaattataattctgtttttaatgaccttattagctcagatgatgttttaatgatttgagtttatgtattatttgaagaatctctaaatagcactattaagtgctctgatatgcagtaatatttatattgagaagcaacttttttaattgtttggggaaagacttctatttcttatgacatgcttccttttcattgaggaatacccaagataccaagttttctttcagaagtaatttgcattttccaccttgaagttgtatttgccattttgtttgttgccataggaaaattcttttttgagaatttttttcttataacgttcttcatctgattaaacaaacaaaaaacccatctttatttttagactaaaagcctttgaataaaatattatacaactttaaataaatttaagatgacattatgacttattaggccacagttaaatatgagcttcatctattagtgagtcaatcataggattttcacacatggcttttgttcacagtaagttatatcaattaagttgcttagaatgaacatatagctgaactaataagcatgaaatattttcactgatttataagaatccagaaattatcaatgagttttctttttctattatttaaaaaagtttttgcttggcaaatcttcccctctaggagattaaagtattttttgctcattaatcaatgtaagaacaccttactttacattcattgaactctgaggttatagaactgtgaacttttcgatttgttcggcttggggaatgtcatagttcattctgtgagtggaagttgcctttaaccacatgagaacaaataagggaatattaaggttttaactcaaggcagctgatatgcaatggctgggataatggccattacctaaaagaaagaaggcagcaaatggttccagacatttataattatgcatctgaagtcagaacaccttttctttttaaacattttcaatttgtgatctgcttgaggacttgtacatagataggctcaagatattttgagtcacatatgtaaatgaaatgttttgagcaaagttgtaaccctgcccacaaaatagctttgctagggaacagatgtaacttggagaagtaccaattttgtcattctagatgagaaatcttctggtgccatcaatgggatgcaatttggctagtcacacctgggtgaccaatatccggaggctctacgtcaagtcattgaacatggatggatgctccattaagtcatttaaaataaacttcctagcaagtgatctctagcatctcaatttaactgtatcctttggagatttaaggaaaactgacaaagct

SEQ ID NO: 134455 - DNA, 3278 bp, Homo sapiens
  Payload ID: 6263
  Gene Symbol: FLRT2
  Gene Name: fibronectin leucine rich transmembrane protein 2
  Uniprot ID: O43155
  ENST ID: ENST00000554746
  CDS Start-End: 706-2688
catcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaattctataatgtaagaatggaggtagttaccctgatttgaccctgtgtgggaaatgctgaaagcaccaggaggaagccggttcccgtgagataag

SEQ ID NO: 134456 - DNA, 3971 bp, Homo sapiens
  Payload ID: 6264
  Gene Symbol: FLRT3
  Gene Name: fibronectin leucine rich transmembrane protein 3
  Uniprot ID: Q9NZU0
  ENST ID: ENST00000341420
  CDS Start-End: 460-2409
ctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaa

SEQ ID NO: 134457 - DNA, 4776 bp, Homo sapiens
  Payload ID: 6264
  Gene Symbol: FLRT3
  Gene Name: fibronectin leucine rich transmembrane protein 3
  Uniprot ID: Q9NZU0
  ENST ID: ENST00000378053
  CDS Start-End: 258-2207
agtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgttgggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 134458 - DNA, 522 bp, Homo sapiens
  Payload ID: 6265
  Gene Symbol: FANK1
  Gene Name: fibronectin type III and ankyrin repeat domains 1
  ENST ID: ENST00000368689
  CDS Start-End: 65-466
tgtcacacagataaatatgagtcacaggagtttgttgtacatagtattacatcacccagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggagggtgagagaactctgtcagttgttttttttcccccatgcctataaagtgcatagaaataca

SEQ ID NO: 134459 - DNA, 949 bp, Homo sapiens
  Payload ID: 6265
  Gene Symbol: FANK1
  Gene Name: fibronectin type III and ankyrin repeat domains 1
  ENST ID: ENST00000368691
  CDS Start-End: 85-933
gttccttcttccacatgtatccctcagtatctagaaccctgaaattggtttctctaagaaaaccaagaggcccataaggaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcat

SEQ ID NO: 134460 - DNA, 1294 bp, Homo sapiens
  Payload ID: 6265
  Gene Symbol: FANK1
  Gene Name: fibronectin type III and ankyrin repeat domains 1
  Uniprot ID: Q8TC84
  ENST ID: ENST00000368693
  CDS Start-End: 105-1142
cacttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacct

SEQ ID NO: 134461 - DNA, 1296 bp, Homo sapiens
  Payload ID: 6265
  Gene Symbol: FANK1
  Gene Name: fibronectin type III and ankyrin repeat domains 1
  ENST ID: ENST00000368695
  CDS Start-End: 123-1142
cacttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaa

SEQ ID NO: 134462 - DNA, 499 bp, Homo sapiens
  Payload ID: 6265
  Gene Symbol: FANK1
  Gene Name: fibronectin type III and ankyrin repeat domains 1
  ENST ID: ENST00000417114
  CDS Start-End: 129-499
tgggctgtgaaaaaaatcatttgttcaacactgatgtcgtgatacaaggacgtgaagatgtgagtcattgtgacatcaccagccagaattgctgggattcagtgagatgactcacagtaagagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatact

SEQ ID NO: 134463 - DNA, 753 bp, Homo sapiens
  Payload ID: 6265
  Gene Symbol: FANK1
  Gene Name: fibronectin type III and ankyrin repeat domains 1
  ENST ID: ENST00000456942
  CDS Start-End: 1-599
gagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaa

SEQ ID NO: 134464 - DNA, 672 bp, Homo sapiens
  Payload ID: 6265
  Gene Symbol: FANK1
  Gene Name: fibronectin type III and ankyrin repeat domains 1
  ENST ID: ENST00000445510
  CDS Start-End: 275-672
agtgtctggttcagtagttccttcttccacatgtatccctcagtatctagaaccctgaaattggtttctctaagaaaaccaagaggcccataagggtaatgtatactgttgatttttatggttatttttcaaaaactaatattttaaacatatcaaaattatttcaaatggtaatgtactcaatgtaccatttggtttaagatgttaacattttgccatatatgtcataaagtcttttcatgaagaaatcaaaccttacaaatatactgaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagtagcatttggcttggaggagagcccataagtagtgagcacttgcaccgggctgtcagtgtgaatgatgaagatttgctggtccgaatacttcaaggagg

SEQ ID NO: 134465 - DNA, 1831 bp, Homo sapiens
  Payload ID: 6266
  Gene Symbol: FSD1
  Gene Name: fibronectin type III and SPRY domain containing 1
  Uniprot ID: Q9BTV5
  ENST ID: ENST00000221856
  CDS Start-End: 148-1638
aatgcgcgcggtgatggagcgctaaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgtacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacactggc

SEQ ID NO: 134466 - DNA, 401 bp, Homo sapiens
  Payload ID: 6266
  Gene Symbol: FSD1
  Gene Name: fibronectin type III and SPRY domain containing 1
  ENST ID: ENST00000594438
  CDS Start-End: 1-379
gccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagct

SEQ ID NO: 134467 - DNA, 254 bp, Homo sapiens
  Payload ID: 6266
  Gene Symbol: FSD1
  Gene Name: fibronectin type III and SPRY domain containing 1
  ENST ID: ENST00000601006
  CDS Start-End: 59-254
tggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcgctacgagccggacagcaaggcgttcggcgtgggcgtggcctaccgcagcctgggccgcttcgagc

SEQ ID NO: 134468 - DNA, 653 bp, Homo sapiens
  Payload ID: 6266
  Gene Symbol: FSD1
  Gene Name: fibronectin type III and SPRY domain containing 1
  ENST ID: ENST00000597480
  CDS Start-End: 1-530
gctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgtacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtc

SEQ ID NO: 134469 - DNA, 1634 bp, Homo sapiens
  Payload ID: 6266
  Gene Symbol: FSD1
  Gene Name: fibronectin type III and SPRY domain containing 1
  ENST ID: ENST00000597590
  CDS Start-End: 72-1385
ggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgtacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccac

SEQ ID NO: 134470 - DNA, 7062 bp, Homo sapiens
  Payload ID: 6267
  Gene Symbol: FSD1L
  Gene Name: fibronectin type III and SPRY domain containing 1-like
  ENST ID: ENST00000374707
  CDS Start-End: 177-1112
gaacctggtaagctcctggaggtaaaactcacaaatgtgtggggacactcctatgactgggtctccttggagctggactctcagacattctgctgtattccttaatccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactctt

SEQ ID NO: 134471 - DNA, 7664 bp, Homo sapiens
  Payload ID: 6267
  Gene Symbol: FSD1L
  Gene Name: fibronectin type III and SPRY domain containing 1-like
  ENST ID: ENST00000374710
  CDS Start-End: 188-1714
ctttcaccctggcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagtgtccatgttacttcactgaagaaacatacaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactctt

SEQ ID NO: 134472 - DNA, 1947 bp, Homo sapiens
  Payload ID: 6267
  Gene Symbol: FSD1L
  Gene Name: fibronectin type III and SPRY domain containing 1-like
  ENST ID: ENST00000394926
  CDS Start-End: 99-1628
agtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagtgtccatgttacttcactgaagaaacatacaagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggt

SEQ ID NO: 134473 - DNA, 1804 bp, Homo sapiens
  Payload ID: 6267
  Gene Symbol: FSD1L
  Gene Name: fibronectin type III and SPRY domain containing 1-like
  Uniprot ID: Q9BXM9
  ENST ID: ENST00000481272
  CDS Start-End: 120-1712
ggtgccggtgcgggctggggcagtgcagtgagtagcggtcttggggtgtgcgatctcgctgagcctcctcacacggttcgtcgtctcgggttcgagcccagtgggcttagccactcgccatggactcccagaaatactgctttaaggagaatgaaaacgttacagttgataaagcctgttttctgatctctaacatcactattggaccagagtctattaacttgcagcaggaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagaagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatca

SEQ ID NO: 134474 - DNA, 1711 bp, Homo sapiens
  Payload ID: 6267
  Gene Symbol: FSD1L
  Gene Name: fibronectin type III and SPRY domain containing 1-like
  ENST ID: ENST00000484973
  CDS Start-End: 99-1592
agtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagtggtacaccatccccaaaacgaacatctgtaggctccaggccaccagcagtaagaggcagtagagatcgttttactggagaatcatacacagtgctgggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcct

SEQ ID NO: 134475 - DNA, 1906 bp, Homo sapiens
  Payload ID: 6267
  Gene Symbol: FSD1L
  Gene Name: fibronectin type III and SPRY domain containing 1-like
  ENST ID: ENST00000495708
  CDS Start-End: 426-1571
tttccttcccgggccctccgcaccggccggctgctggatgcccagtggcctatttcagggccggagagaccgctatcgctggaggaaaaaggatgggggaagggagtgcagcctgcagaggcactagcggtagacagacgggcggcgctccccaccctccacggctacttcccgggagcagtcagccgctgcgcgcaggcgcggtgcgctcctcagcccctcccttctgcgggccgccctttcaccctggcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaatactgctttaaggagaatgaaaacgttacagttgataaagcctgttttctgatctctaacatcactattggaccagagtctattaacttgcagcaggaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggctgccagacagatcaaggatagagtcacaatggcttcagcctttcgcctttctttgaaaccaaaggtcagtgacaacatgactcatttaatggtggatttctcacaggaaagacagatgctgcaaactttgaagtttttgccagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggcttaaaatttgattcaaagtatatgaatttcagagtgcgagcttgtaacaaggctgtggctggagagtattctgatccagtgactctagagaccaaagcacttaacttcaatttggataactcctcatcccatttgaacctgaaagttgaagatacatgtgtagagtgggatcctactggaggaaaaggtcaagaaagtaaaattaaaggaaaagagaacaagggcagttacaaatttttaaaaattgtttttctgttatcaaaagagctcttaatacattttgaagcagtgctaagtgaaatttttctctttatttgtatgacgttcactttctatttgttgccctgagttacttgggaaatatttttcagaatgcatgtttcctctcagcagacactctgaccaccagttggggaggcaaactatcagtgtattttgaaaaagtttcctgattgtttctgaatctgctgtgccttttcagttgacaatcattgatttattacaaaatgccaaaggcctttgttttttcaatttagtactttggctcaggaagatacaggtgttccttaattgatagtatcacatactctactcagctgagctcattctagtcagatattgtacacctactctgtactgaggatacagagatgagatgtggttcctagcaacagttagttccc

SEQ ID NO: 134476 - DNA, 1836 bp, Homo sapiens
  Payload ID: 6267
  Gene Symbol: FSD1L
  Gene Name: fibronectin type III and SPRY domain containing 1-like
  Uniprot ID: Q9BXM9
  ENST ID: ENST00000469022
  CDS Start-End: 177-614
gcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttgataagtaaaatgctggctgttcatttattccaaagcaaacacttagaagtgtgtgtctttagggtcatcaacaaatatgtttaaaaagtgtttctgtgtttctgtctatgagctgcttgggaaagcatcatcactttatgcacatgagcactgtaattgtgtaacttcttattgcagataaatgcccccactgcttaatttaagtaactgaatgttttattacaacatggaaatgtagatccttacttaagggatatgtttagtataaaaatgtaaaaagtagagcaagaagcctgctaatgttttaacttagatcctggtgtttaagtgattgtaaattgtaaattgtaattttttttttaagtagggtcattttaaatgattaccattttgtcaaatcaaaactcagaaatgtagaatatattttaaaatgatgtgaaaagatttggaaattaagctatataattagcaaaaattactgtgtagttatcaagataaaatttgagtttgatgttatttacttcacctttgtggagtatgtagtgagctgcattgtgttagaaaggtagctttataactgatttatgcctagtgattgttttcattttatgattttctgtgaacttgaaggtagaaaaaacttccttgagaaggtaacatttgccaccttacatctttggatattaaaattgaactttaattgatttcttcttttaaacacatgaatcaaaacaaaagttcttttgctgtaagccaatgcatgaattaattctttaaatttggaggtgagttgtaaagaagcttactaatgcacataggtggacttattatataaaggaattacaagggaaatgtactatatttaaaagtactttaaaagtatgatatgttggccaggtatggtggctcatgcctgtaatcccagcactatgggaagccaaggtgggtggtttgcttgagcccaggagtttgaggccagcttgggcaacatgatgagatcctgcctgtacaaaatacacaaaaaaattagccgggcatggtgatgtgcacctgtagtcccagctactcgaaggctgagatgggaggattgcctgagcctaggaagttgaggctgcaccgagctgtgattacactgctgcactctagcctgggcaacagagcgagaccctatctcaaacaaaacaaaaca

SEQ ID NO: 134477 - DNA, 6418 bp, Homo sapiens
  Payload ID: 6268
  Gene Symbol: FSD2
  Gene Name: fibronectin type III and SPRY domain containing 2
  Uniprot ID: A1L4K1
  ENST ID: ENST00000334574
  CDS Start-End: 183-2432
atgcagaggtcactaggaaggaaagcctgctgaacacagattcaattttctagcagaactccaggtcctctgagttaaaggaagcatttatggacgcttagcagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggagaattttggaaaacaagaacaaaactttgagtcacattacaacgagatcttggaaacacttgctcaaaaatatgaggaaaaaatacaagctctaggggagaaaaagaaagagaagctggaagccttatatggacaactggtcagctgtggagaaaacctagatacttgcaaagaactgatggaaacaatagaggagatgtgtcacgaggagaaggtggatttcataaaggatgcagtggctatggctgacagactcgggaaattcctgaaaacaaaaacagacgtggaaatctctgcacagcctgagtttgaagaccagaccttggatttctctgatgtggagcagctgatgggctccattaacaccattccagctccttctgctccagtcataaatccacaggtccctaactcagccacaggttcctcagtccgagtgtgctggagcttatactccgacgacactgtggagagctatcagctgtcctaccggccagtgcaggacagctcacctgggacggaccaagcagagtttacagtgactgtcaaagaaacatattgctcagtgacaaaccttgtgccaaatacccagtatgaattttgggtcacagctcacaacagggctggccccagcccctctagcgagcgtgcagtgtacatgacagcaccttctccccccattattaaaaccaaagagataaggagctgtgaagaggctgtgctgatttgctgggagtctgggaacctgaatcctgtggactcgtacactgtggagctgacccaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaacctggcacttaagcaccatgtgcccagcacaatttatggctcatgctattatctgactggtgtgctagcgctcatttcacccaacctggattctagtcctgtgtgctgctacctgtgtgctgctaggatagtcattaccaggcccagctgtaaaataaaggctcagactaaacgaactcaaaagtctttgaagctgtcaaactatattcgtgtatatgcaaaatatcttgagtttccaagacctagagagcttgggagaggacgagggtagtcttaatggctccagcagcaccagtacacccatgcatttcatgagtcagccaagaatacacttgagaaggcgagaggctgtctgtagagaaccagggaagctgtgtgcccttctcaatgtcttctaccctcgttttcccaatagtgagcagcactgtggtgaggtcccttccactgtgtactctgcatacagggtattccctgttccactcctacacagtatgcaccactctctaattttgaaattacctctataatgcctaattccatgaagggagggacagtgcctgttttgttcattgctagatcaccaagggctaacacataacagctgtcaccaagtatttgttgaataaattagtatcttcttcagccactgctctttggcctcttactgctctccatgtgaaggatggcagggctctttcaaaactacagcaaaggacctatggccaagaaatgggaaaaaacctagaatggaggcagcgtgaaagaacagaagggcatctgtggcatattagcaaatgcacaacaattttttaaaagaaattaacagcccaccaaagggcaaagctgagcacgggaaggaagactgatctctagctaggcagctttcaggcatcctgcctcactgcccccaggccattctgtgagctcaatgcccaactccatcagctacattcctggttctcctgttcaagtttccagttgccacttaagctctgcacacacagcattttcaaagcttgtgagtgaagctgcagaataattccatttgtgaagcaattacaattcagtatcatgtcccacagatgcctctaaacccagatatgccctaatctcatcatttaaggttttgtgtttaaaaaaaaaaagtccacttttcttttttctggcgaaaccccgtctctactaaaaatacaaaaaattagccgggcatggtggtgggcgcctgtaatcccagctactcaggaggctgaggcaggagaattgcttgaacccgggggcagaggctgcagtgagccgagattgtgccactgcactccagccttggcaacaagagcgcaactctgtctcaaaaacaaacaaacaaacaaacaaaaaacctctgatgttttccagcacctgcaaagtctgacaaactgaaagactctcatctcctactaaactctgcctactcgtataaatggcagctcagattcctgaattaacaattcacactgacaatttaataactcgttatacacacacacacctatcctgccaagctggactgtctactctgaaacaagggacagcagatgtaagcacagaaatagttccagttataaacaattaaaagatacatatcatgtatatttaaaaatgttctcggccgggcgcggtggctcacgcctgtaatcccagcactttggggggccaaggtggatggatcacaaggtcaggagatcgagaccatcctggctaatacggtgaaaccccgtctctactaaaaatacaaaaaaattagccgggactggtggcgggcgcctgtagtcccagctactcgggaggctgaggcaggagaatggcgtgaacccgggaggtggagcttgcagtgagccgagatggctcacagatcaagactccatctcaaaaaaaaaaaaaaaaaaagttctcagctactgaaatagaaactaccaagtaagaaacaggatatcacagagaaggcaagtttgaattcagggttctaataggctttatggaatactacacgttagtatgaacacggataaatggattaaaaactcaacacgtataaagttttaattaaatttttatttgaccaagaaaaaactgtctagaattgcctgacatttaaaatccacttaaagcagattagcaacttcaagcatcacaattattcagcataaagagcctttgttgaaacatctttctcatttatttagaagaaaacatctagaacagaaccaagcaaaacttttgtatttttgtaaaaaatctcaattcctgaaactactataaacaatctactgaaactgtattcagcaagggacagatttacctcaaggccatgttcacctgcaacctgctgataagtctgttaaaaaacaaagcaaaaaaaagagtttttaaaaattagaccactgtagccacaatccctaacactggacagttaaaacaaaagttatcaaaatctgttcttttcttagctttacctgtatcactttataactcctgagaaagtcattcacataagctgtggcctccccaccttaacaaaggggaaaaagaatatgtaaaaccaccacagaatcttggcgtaaactaacatgggtttagtaatacagagtacagtattcaggatttaaggcacccttacaagtcagaattggaaagttggtttgagacttgcaatctaaaatgacactgatttctgataaaattaaatgacttttatttagaaaagtgtgtttaataaattacttcctgctggttcaaatgacacacaatcactttgtatacatccaataagatatttctgaagtgtatacttggtcaaaagtaaaaagcagagcaaatgcatggacagtggggccttcttcttaatacttctcatcctccaaaatctgttaaaatcatcatcttccacaactcacacactggaagctgtccacagcacaattcactgtgatgtggcattctgtaaataagactacattggtcttgatgcaaggcggttcagctaccagactgcactataagaaaagtcctctcctcaacttaccaagaaaacttcgccaatttctagtcaccttcctatcaattagtagagcaagattctcacatgttcactatgtctttctccagttttctcatctataagtgtactactcctattttctataggaagacaatggaaagcgtgtaattgctgttggtagataagtaggtcttgaatttattttgcaaacaagacctgttctatctaccttttcatttaggaggctaaaagcagagtcagcttgatttcaaggactctattttcttagtctccagaagaacataaccaaatccagcttttaaaacactgtcctttaacaagtcaagatactcaaataaagatcatgtataacttcaagctataggagattaactctgtacatatgcttgtttcactgtaaccaatggttaattaatctaaatgcaagagaaaagttatttggaaagaagaccccagctggtcagcatcttttctgtcatcaggaagtctcctggaaggagtatgactatgacctgggcacaacaactgcccctaagttagtacttattttagagttgctactgaacaggtggtggttcttgtcaagtatatcatgtctgactactttactgcttgttttctgctatcaccagttccagaaaaaaaaaaaaaaaaaattaagcccaactcactaattgattgctttttcattttcccagactgtgacagaatcatggtttttagctctattttcaccttactcaaatcctggaggaattaaactatcatttatttgaaatgttacaaattagcctgcagttgattcaaacaacatgtagtcactcagacatagcaaataaaaatgttttggtatatgaa

SEQ ID NO: 134478 - DNA, 2356 bp, Homo sapiens
  Payload ID: 6268
  Gene Symbol: FSD2
  Gene Name: fibronectin type III and SPRY domain containing 2
  Uniprot ID: A1L4K1
  ENST ID: ENST00000541889
  CDS Start-End: 168-2282
ggaaggaaagcctgctgaacacagattcaattttctagcagaactccaggtcctctgagttaaaggaagcatttatggacgcttagcagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggagaattttggaaaacaagaacaaaactttgagtcacattacaacgagatcttggaaacacttgctcaaaaatatgaggaaaaaatacaagctctaggggagaaaaagaaagagaagctggaagccttatatggacaactggtcagctgtggagaaaacctagatacttgcaaagaactgatggaaacaatagaggagatgtgtcacgaggagaaggtggatttcataaaggatgcagtggctatggctgacagactcgggaaattcctgaaaacaaaaacagacgtggaaatctctgcacagcctgagtttgaagaccagaccttggatttctctgatgtggagcagctgatgggctccattaacaccattccagctccttctgctccagtcataaatccacaggtccctaactcagccacaggttcctcagtccgagtgtgctggagcttatactccgacgacactgtggagagctatcagctgtcctaccggccagtgcaggacagctcacctgggacggaccaagcagcaccttctccccccattattaaaaccaaagagataaggagctgtgaagaggctgtgctgatttgctgggagtctgggaacctgaatcctgtggactcgtacactgtggagctgacccaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaac

SEQ ID NO: 134479 - DNA, 603 bp, Homo sapiens
  Payload ID: 6268
  Gene Symbol: FSD2
  Gene Name: fibronectin type III and SPRY domain containing 2
  ENST ID: ENST00000561368
  CDS Start-End: 301-603
catgcagaggtcactaggaaggaaagcctgctgaacacagattcaattttctagcagaactccaggtcctctgagttaaaggaagcatttatggacgcttagcagccactggggaccagctctggccaggacaattccgtttgccatgatgtgggttgaaatcacaacttctcccgggcgcagtggctcacgcctctaatcccagcactttgggaggccaagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttca

SEQ ID NO: 134480 - DNA, 6552 bp, Homo sapiens
  Payload ID: 6269
  Gene Symbol: FNDC1
  Gene Name: fibronectin type III domain containing 1
  Uniprot ID: Q4ZHG4
  ENST ID: ENST00000297267
  CDS Start-End: 201-5885
ctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcagttgaccacccactgaagccaaggcatgtgaaactgctgtccactaaaatgggcctgaaagtcacgtgggacccacccaaagatgctaccagtagacctgtggagcattacaacattgcctatgggaagtcactgaaaagtcttaaatacatcaaggtgaatgcggagacatactccttccttattgaggatgtggagccgggggtagtgtactttgtgctgcttactgcagaaaaccacagtggagtgagccgtcctgtttacagagctgaaagcccacctggaggtgaatggatcgagattgatggttttcccattaagggtccaggaccatttaatgaaaccgtcacagaaaaggaagtgcccaacaagcccttgcgtgtgcgtgtccggtcctcagatgacaggctgtccgttgcgtggaaggcaccacgcctgtctggagccaagagtccacgcagatcacggggttttctcctgggctacggggagagtggccggaagatgaattatgttccactgacaagagatgaacggacacacgaaattaaaaagctagcctcggaatccgtgtatgtggtctccctgcagtccatgaactctcagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttgagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcccggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccgcccgcagcacggtcacagcagcatcccagtgttcccagaaggatgacacccggccgggccccacaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggtggagtctcccacaggcgcaggggcaggtggcgaccacaggtcccagcgcggacatgcggcctcccccgccaggcccagccgacccggcggcccccagtcccgcgcccgggtacccagcagggcagcgccggggaagtcggagcctccttccaagcggcccctgtcctccaagtcccagcagtcggtctcagccgaggacgacgaggaggaggacgcgggattttttaaaggcgggaaagaagaccttctgtcttcctctgtgccaaagtggccctcttcctccactcccaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgactgccgcctcgcagcgctgccaccgtgagccccgtcgcgggcacccacccctggccgcagtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcgtgctcagccccgctgccctaggtgccaggaaggtcatagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccagat

SEQ ID NO: 134481 - DNA, 6034 bp, Homo sapiens
  Payload ID: 6269
  Gene Symbol: FNDC1
  Gene Name: fibronectin type III domain containing 1
  ENST ID: ENST00000329629
  CDS Start-End: 1-5371
gccaaggcatgtgaaactgctgtccactaaaatgggcctgaaagtcacgtgggacccacccaaagatgctaccagtagacctgtggagcattacaacattgcctatgggaagtcactgaaaagtcttaaatacatcaaggtgaatgcggagacatactccttccttattgaggatgtggagccgggggtagtgtactttgtgctgcttactgcagaaaaccacagtggagtgagccgtcctgtttacagagctgaaagcccacctggaggtgaatggatcgagattgatggttttcccattaagggtccaggaccatttaatgaaaccgtcacagaaaaggaagtgcccaacaagcccttgcgtgtgcgtgtccggtcctcagatgacaggctgtccgttgcgtggaaggcaccacgcctgtctggagccaagagtccacgcagatcacggggttttctcctgggctacggggagagtggccggaagatgaattatgttccactgacaagagatgaacggacacacgaaattaaaaagctagcctcggaatccgtgtatgtggtctccctgcagtccatgaactctcagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagccagtaaggcggatgttgagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcccggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccgcccgcagcacggtcacagcagcatcccagtgttcccagaaggatgacacccggccgggccccacaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggtggagtctcccacaggcgcaggggcaggtggcgaccacaggtcccagcgcggacatgcggcctcccccgccaggcccagccgacccggcggcccccagtcccgcgcccgggtacccagcagggcagcgccggggaagtcggagcctccttccaagcggcccctgtcctccaagtcccagcagtcggtctcagccgaggacgacgaggaggaggacgcgggattttttaaaggcgggaaagaagaccttctgtcttcctctgtgccaaagtggccctcttcctccactcccaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgactgccgcctcgcagcgctgccaccgtgagccccgtcgcgggcacccacccctggccgcagtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcgtgctcagccccgctgccctaggtgccaggaaggtcatagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcacc

SEQ ID NO: 134482 - DNA, 5714 bp, Homo sapiens
  Payload ID: 6270
  Gene Symbol: FNDC3A
  Gene Name: fibronectin type III domain containing 3A
  Uniprot ID: Q9Y2H6
  ENST ID: ENST00000398316
  CDS Start-End: 88-3516
agccgttctccaattaaagctgttaacgtgtactacgctgtttccttgttggattttcttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttga

SEQ ID NO: 134483 - DNA, 6286 bp, Homo sapiens
  Payload ID: 6270
  Gene Symbol: FNDC3A
  Gene Name: fibronectin type III domain containing 3A
  Uniprot ID: Q9Y2H6
  ENST ID: ENST00000492622
  CDS Start-End: 306-3902
ctcccggctccgtagtaagcatggcggcggcggcgttcgtggtccctcgggtgaaacagaaagcgggagctacgcggagagggagcgaagagcggggctgaggcggcggcgtcactgccaggaaacaaccccaacagtcagcgcgccggcggccgcggcggccctgagagctgactctgcagctgaggtagagagacaacgatcaggaaccctaagaagaggcgccagaggagccgccttctgcctcagaacggcgtgactcggagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatccta

SEQ ID NO: 134484 - DNA, 582 bp, Homo sapiens
  Payload ID: 6270
  Gene Symbol: FNDC3A
  Gene Name: fibronectin type III domain containing 3A
  ENST ID: ENST00000497644
  CDS Start-End: 1-420
gtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacgaaacatccaatcaaaaataatgggatgcattcaacttatagataacatattaggagaaatatgtatgatattcaacttcattgaacagttcaagtgggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatggga

SEQ ID NO: 134485 - DNA, 6082 bp, Homo sapiens
  Payload ID: 6270
  Gene Symbol: FNDC3A
  Gene Name: fibronectin type III domain containing 3A
  ENST ID: ENST00000484074
  CDS Start-End: 285-2339
agccgccgaacttgaacgcttttctgaagagagttttccccgctcatcttggggttaaaacctcgaaaacccgccctctgtttgatcctgcgtggctgcttccagtacctggcagttcctctccccgggcgagttaaccacctgttcagtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgt

SEQ ID NO: 134486 - DNA, 6328 bp, Homo sapiens
  Payload ID: 6270
  Gene Symbol: FNDC3A
  Gene Name: fibronectin type III domain containing 3A
  Uniprot ID: Q9Y2H6
  ENST ID: ENST00000541916
  CDS Start-End: 349-3945
ggggcggaatcctcctgagaggatcgcccagcacccgcggcgccttcggctttggccgcccggcagccgccgaacttgaacgcttttctgaagagagttttccccgctcatcttggggttaaaacctcgaaaacccgccctctgtttgatcctgcgtggctgcttccagtacctggcagttcctctccccgggcgagttaaccacctgttcagtcgggaggtggactcgaggctgcagtcctcgcccggttttaacaacctggatcttcgaacttttgacacggctttggaaacgacgtcatgtgttagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtaggagaagaaacaaatatcactttaaatgatctcaagccagccatggattaccatgcaaaagtccaggcagaatataattctataaagggaactccttcagaggctgaaatctttaccaccttgagctgtgaacctgatatacctaatccaccaaggatagccaatcggaccaaaaattcactcactttgcaatggaaggcacctagtgacaatggttctaaaatccaaaactttgtattagaatgggatgaaggaaaaggaaatggagaattttgtcagtgttacatgggctcacagaaacaatttaaaattactaaactttcaccagcaatgggctgtaaattcagactatcggccagaaatgactatggtacaagtggttttagtgaagaagtcttatattacacctcaggctgtgctccttctatgccagcaagtcctgtattaaccaaggctggaattacttggttatccttacaatggagtaagccctcaggaacaccatcagatgaaggaatttcttacattttagagatggaggaagaaacttcaggatatggttttaagcctaaatatgatggagaagatcttgcttacacagtgaaaaatctcagacgtagtactaagtataaatttaaggttattgcttacaactcagaaggtaaaagtaatccaagtgaagtagtagaatttactacttgccctgataaaccaggcatacctgtaaagccttcagtgaaaggaaagatacattcacacagttttaaaataacctgggatccaccaaaagacaatggcggagcaaccatcaataaatatgtagtggagatggcagaaggttctaacggaaacaaatgggaaatgatatacagtggtgctaccagggaacatctttgtgatcgactgaatccaggctgtttctatcgtttacgagtttactgcatcagtgatggaggacagagtgcggtctctgaatctttacttgtgcagactccagctgtgcctcctggcccatgcctccctcccagattacagggtagacccaaagcaaaagaaatacagttacgatggggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatggggtttggaccattttcagaaaaatgtgatattactacagcccctgggccaccagatcagtgcaagccccctcaagtgacatgtagatctgcaacttgtgcacaagtgaattgggaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaagcccccaaaatagagaaagtaaatgatcacatttgtgaaattacatgggagtgtttacagccaatgaaaggtgatccagttatttacagtcttcaagttatgttgggaaaagattcagaattcaaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcct

SEQ ID NO: 134487 - DNA, 2037 bp, Homo sapiens
  Payload ID: 6270
  Gene Symbol: FNDC3A
  Gene Name: fibronectin type III domain containing 3A
  ENST ID: ENST00000378383
  CDS Start-End: 149-1129
gcggccctgagagctgactctgcagctgaggtagagagacaacgatcaggaaccctaagaagaggcgccagaggagccgccttctgcctcagaacggcgtgactcggagaattggagcgttattcagtatattaatgtcttattgataatggcagaacatccaccactactggatacaactcagatcttaagtagtgatatttctcttttgtctgcccctattgtaagtgcagatggaacacaacaggttattctggtacaagttaacccaggagaagcatttacaataagaagagaagatggacagtttcagtgcattacaggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaagaaaaagatgaagaaactaaagcatttgaagcacttctttccaacattgtcaaaccagtggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtgtaggtatttgttgttttgctttctcccattgtgtaaattaatggtttattataaagagcttattactaattttgctctacttttccttcttcacgcttttattctgaatctttaagttggctaatgatagtgatttcaatgtaaatggtccaaatgtagcttggtacacatttctgtctaccttccttcagaataatcacttttattggccacattcagctttttttttcccagtaggctccctaatagatggttcagtattcacgtattcttaatgcattaaatataagttgtagtatgtagaacccatgaccaaaaatggacaattcatgattgtaaactcataaagtatgacattgctcctctaaggactggatttaattcttacatgtacaagctcatgtcctgttgtaaaatgaatttagtagcactgttatttatttgcatgttagtatgtttatagtcatattttgaaaacttacgtatttctttccttggtttaaaagtatattacacacagccaggcacggtggctcacgcctgtaatcccagcactttgggaggctgaggcgggtggatcacctgagttcagcagttcgagaccagcctggccaacacggtgaaaccccgtctttactaaaaatataaaaattagccaggggtggtggcacatgcctgtagtcccagctacttaggacgctgaggcaggagaatcgcttgaacctggcaggtggcagttgcagtgagccaagatcgcgtcattgcactccagcctgagtgacagagtgagactccatctcaagaaaaaaataaaagtatattacgcaccacgaagccttagaaagattcagtagctaaagttgtgacatttatgattgacagttttgaaataaattattctgtccatattc

SEQ ID NO: 134488 - DNA, 7904 bp, Homo sapiens
  Payload ID: 6271
  Gene Symbol: FNDC3B
  Gene Name: fibronectin type III domain containing 3B
  Uniprot ID: Q53EP0
  ENST ID: ENST00000336824
  CDS Start-End: 100-3714
aagctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctgacttaaatagggtttttctgccatgactaggattgcttttgttgttgttgttgttgtttctttctttttttttttttttgagacggagtcttgctctgtcgccaggctggagtgcagtggcgcgatctcagctcactgcaacctccagctcccaggttcaagtgattcccctgcctcagcctcccaagtagctggggattacaggcactcgccaccatgcccggataattttttttttttttttgagttggagtcttgctctgtcgcccaggctggagtgcagtgacccaatctcggctcactgcaagctccacctcccgggttcatgccattctcctgcctcagcctcccaagtagctgggactacaggtgcccgccaccacgcccggctaatttttttaattttagtagagtcggggtttcaccatgttggccaagatggtctcgatctgacctcgtgatctgcccgcctcggcctcccaaagtgctgggattacaggtgtgagcccccgcacccagccttattcttcccttttaaatacttaaagcacattcagattagttgaaaattcacgtgtttttggaggccaggcaggtggccttctgcagagacagcagcagctcagctcttgctgaccaaggccttggaggactgtgagccacaatcacatatgtccatgtttcaaaagaagctaaatatccagatttcctccatgggccaactaaaaggtgattgtggactatacaggctgccagtttaatcctttatcagagtctctgtggataatgtaccttgttgcctaatactttatctgtctaccaaaactcagtccagatctccctctgttcacctggcacactgggtgcttcctctcccctgacgaactctatagagtgttcatgtcctttcctgcaggtctcattcaacaacaacaacaacaacagcaataaaacacagtgttcctgcta

SEQ ID NO: 134489 - DNA, 678 bp, Homo sapiens
  Payload ID: 6271
  Gene Symbol: FNDC3B
  Gene Name: fibronectin type III domain containing 3B
  ENST ID: ENST00000443501
  CDS Start-End: 55-678
agcagacactggaatgtgaatgcattgggaggtgagcccttaaggagagcccaaatgtttaccaaagagaaaatctggtcagaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcgga

SEQ ID NO: 134490 - DNA, 3684 bp, Homo sapiens
  Payload ID: 6271
  Gene Symbol: FNDC3B
  Gene Name: fibronectin type III domain containing 3B
  Uniprot ID: Q53EP0
  ENST ID: ENST00000416957
  CDS Start-End: 64-3678
agtgtctaccaccaaactcctaaggctggatggtggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaa

SEQ ID NO: 134491 - DNA, 408 bp, Homo sapiens
  Payload ID: 6271
  Gene Symbol: FNDC3B
  Gene Name: fibronectin type III domain containing 3B
  Uniprot ID: Q53EP0
  ENST ID: ENST00000423424
  CDS Start-End: 99-314
agctcgggcgggggagcggggcgcggcgggaaggagcgggcgacccggtgtgtgggccagcggagctccggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgc

SEQ ID NO: 134492 - DNA, 946 bp, Homo sapiens
  Payload ID: 6271
  Gene Symbol: FNDC3B
  Gene Name: fibronectin type III domain containing 3B
  Uniprot ID: Q53EP0
  ENST ID: ENST00000421757
  CDS Start-End: 173-388
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagcaaaaacatta

SEQ ID NO: 134493 - DNA, 5083 bp, Homo sapiens
  Payload ID: 6271
  Gene Symbol: FNDC3B
  Gene Name: fibronectin type III domain containing 3B
  Uniprot ID: Q53EP0
  ENST ID: ENST00000415807
  CDS Start-End: 173-3787
gcggcggcggcggctggaggaggagagcggcggcggcgggagcagcgaagggggcggcagggatcctccaggctgccggctgggaaggcgtgggcgacccggtgtgtggcgcgcccagagccccgcgtttcagccctagggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaacctacatcacccgagaagaccagtacagcaagcctccgcacaaaaaactgaaagaccgccagatcgatcgccagaaccgcctcaacagccctccttcttctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggg

SEQ ID NO: 134494 - DNA, 1657 bp, Homo sapiens
  Payload ID: 6272
  Gene Symbol: FNDC4
  Gene Name: fibronectin type III domain containing 4
  Uniprot ID: Q9H6D8
  ENST ID: ENST00000264703
  CDS Start-End: 393-1097
cgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactgga

SEQ ID NO: 134495 - DNA, 2732 bp, Homo sapiens
  Payload ID: 6273
  Gene Symbol: FNDC5
  Gene Name: fibronectin type III domain containing 5
  ENST ID: ENST00000373471
  CDS Start-End: 68-706
gcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcacccaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaaggca

SEQ ID NO: 134496 - DNA, 837 bp, Homo sapiens
  Payload ID: 6273
  Gene Symbol: FNDC5
  Gene Name: fibronectin type III domain containing 5
  Uniprot ID: Q8NAU1
  ENST ID: ENST00000496770
  CDS Start-End: 215-676
aagagaaaagagagagagaggtgctctggctccggggctcttctcccaaacgggtcgaggtcccagctgaggctctcccaggacaagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaaggtgagggcaagacctgggcctgggtgggccaccctgtgcctcatgctctggtaatccctggactgcagagggggtcagctcggggactggcatggcgacagctgggcagagccagacttggctgctgcctgtgtgacacagggacactgcaagttgattttggatcctctccttttgcagggtgccaggggccagtggtgatttgaagaaaaaaa

SEQ ID NO: 134497 - DNA, 3332 bp, Homo sapiens
  Payload ID: 6274
  Gene Symbol: FNDC7
  Gene Name: fibronectin type III domain containing 7
  Uniprot ID: Q5VTL7
  ENST ID: ENST00000370017
  CDS Start-End: 278-2479
tgctttgaaaccaaggttacagtagctttttggcccgcttgccgtggctttctccaactctcttcttcttttcagtctttgcaatacctgtccctgccggtctccaagtgcccctggttacaggtcagctccacactgaaggggaggagctacttcctagggtctcttcccagcatcacagccctacatcccagcgaccaacggtgttatactcctgggggccaaagaggacccggattgctttgttttgtgccatgtgagtactatgtccaacaggatggctggtggacgagagacatgtttgcctttgattggattcattcttatctgtcttaaaatggttgcttcagcaaaatcagctcctgaaatacccactattgatcaggcatattcaaaactcagcaacagtatcactgtagaatgggctacagtgccgggtgccaccagttacctcctcacggctgaagacggggacacagtcattgaaaccacggtggccaattccccaggcactgtgacgggactaaaggctgcaacctggtatgaaatcaccatcagatccatcagcgctgctgggagaagccaggcgtcacctccaaagcaggcaaagacagtgttggctgcaccaattctagaagtaagctctccaagttcagactccattcttgtgcagtgggaagctgtatatatggcaattgcattctccgtgtccattatgcgagccaatggcttggggagtatatggaaagagaatactacaaacacctccttgacattcaccagtttagaagccggaactctctacaccataaaggcctatgcatggaatgccaacagaatccctggggatgactccacctgcaatcagagaacaagtcctcgggcccctgccaacattcaagtctctttcgatagtggagctctgaaggcatctttttcctgggcacgggcagaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactgttgcttgtgcacccggaagagtgacgatccaagaagatccccctggccacctgtctgtggcttggtccagtgtagatctgggtgactactatgtggtctttgtgaagagtgatgatggcttggaagtacactgcaacacatctctcactcagtgcaacttcttatctgagtgtggcttcacttattttattagtgtttttgtctataacaaggcagggcaaagtcctttgggtgacatattcaattataccacagctccctgttgtcctagtgacattaaccccgtgttggtgtccagtgacagagttgagattgtctggtctcctgtccgtggtgccgaactgtatgaaaccaaggctgtagatgggtacaacatggttgagtgcaatgacactactcctgcgtgcaccctttcggctctagagtgtgacaccaagtacaacatcacagtgtattcattcaatgaagtccgaggcagcaatatgtcatgtactccccagttcataaccacagctccttgcagtcctgaaataaaaaatgtttcaagggatgcattctccatgattaatgtgcactggcgatccactaatgatgatgctacttacacggtgactgcccaaggggagaaaggactgtatcagtgcagcagcacaggagagtcctgcaccatgcggggcttgccctgtggctcagtgttctctgtcactgctgtggccgaaacacaggcaggacggagcctgcccagctacagtgtgcccctggaaacagtgccatgctgtccaaccggtctgacagtaactcaaatcacccagtcagtaatcaacgtgagctggactattgggagagtggctcaaacccatgttgcagttctggagtcacacactggacagtctaagtgtcacactcatcaaaaccactgcctcctaggatgcatcacatgtggcatcaattacacagtgacattaaaagcaattagtgccaccgggttgactgcagattgctcctaccaaagttatttctctggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagataccctgtggggatgtatacactgtgatggtctcaccagttgctaaaacaggattgaagcttactttctgtccaaaaaaaatatattcagtaacttgctctggaagtacacttggaatggtgatttatagagggaagagaaatgaagaatgacaaagtgagccccagataaaaacaaaaacttgaccaaagttgtctcatttgttagtgattagagatggaaaagatctactagaatgtagaataaaaatgcctctaggataggaaaagctcctttggcctttagaagaacaactctgactctgcttcctgagggcaaggtcaggtgtgtcctcacctgcacagcagttggagatctgctatgtgaggactctggagagaaatgaatccagaaagtcccctggacggctgctagcctgagttggcacactgtgagaaccctggaaacaagaaagttctgcttagcagaaattctgagatttcacatccacacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcata

SEQ ID NO: 134498 - DNA, 1667 bp, Homo sapiens
  Payload ID: 6274
  Gene Symbol: FNDC7
  Gene Name: fibronectin type III domain containing 7
  ENST ID: ENST00000445274
  CDS Start-End: 1-1498
agaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactgttgcttgtgcacccggaagagtgacgatccaagaagatccccctggccacctgtctgtggcttggtccagtgtagatctgggtgactactatgtggtctttgtgaagagtgatgatggcttggaagtacactgcaacacatctctcactcagtgcaacttcttatctgagtgtggcttcacttattttattagtgtttttgtctataacaaggcagggcaaagtcctttgggtgacatattcaattataccacagctccctgttgtcctagtgacattaaccccgtgttggtgtccagtgacagagttgagattgtctggtctcctgtccgtggtgccgaactgtatgaaaccaaggctgtagatgggtacaacatggttgagtgcaatgacactactcctgcgtgcaccctttcggctctagagtgtgacaccaagtacaacatcacagtgtattcattcaatgaagtccgaggcagcaatatgtcatgtactccccagttcataaccacagctccttgcagtcctgaaataaaaaatgtttcaagggatgcattctccatgattaatgtgcactggcgatccactaatgatgatgctacttacacggtgactgcccaaggggagaaaggactgtatcagtgcagcagcacaggagagtcctgcaccatgcggggcttgccctgtggctcagtgttctctgtcactgctgtggccgaaacacaggcaggacggagcctgcccagctacagtgtgcccctggaaacagtgccatgctgtccaaccggtctgacagtaactcaaatcacccagtcagtaatcaacgtgagctggactattgggagagtggctcaaacccatgttgcagttctggagtcacacactggacagtctaagtgtcacactcatcaaaaccactgcctcctaggatgcatcacatgtggcatcaattacacagtgacattaaaagcaattagtgccaccgggttgactgcagattgctcctaccaaagttatttctctggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagataccctgtggggatgtatacactgtgatggtctcaccagttgctaaaacaggattgaagcttactttctgtccaaaaaaaatatattcagtgatttatagagggaagagaaatgaagaatgacaaagtgagccccagataaaaacaaaaacttgaccaaagttgtctcatttgttagtgattagagatggaaaagatctactagaatgtagaataaaaatgcctctaggataggaaaagctcctttggcctttagaagaacaactctgactctgcttcctgagggcaaggt

SEQ ID NO: 134499 - DNA, 1388 bp, Homo sapiens
  Payload ID: 6275
  Gene Symbol: FNDC8
  Gene Name: fibronectin type III domain containing 8
  Uniprot ID: Q8TC99
  ENST ID: ENST00000158009
  CDS Start-End: 116-1090
attgcacctgcagactgtccaaactaaaggtgggccactgcccccacagtttctctctgcttctggtcagctgggttgtcctgcatggtgacgggtgtcatcccgaacaaatcagatggcatcagaggcactccatcaagtgggagatggggaggaggctgtactgaagaaagaaaacttcaacatgatgaatgcccttgaccaactgccaaaacccttttcaaaccccaagtctatgaaccggaccgtcactaccaaaggactcccactagcctcaaagggcaatttggtcaacttcttggaggatgataccatcaacctactgaagccgctgccagtagaggattcagactgcagctctgatgagaccagcatctctgccttctcatccaccttgctgaaccccatcaaattagctgtgacccagcccaacagcagcttctttgcagggatgctggagggggagctgaacaaactcagcttctccccaatggccaagaatgcagaaaatgaggacctggcgctcggcccctgcccatgcccatcgaagtcccagatggccacaaggggcctgctggaccttgacaaccctgagctggagacagaaacctcctcaacgcactcagaatcttctgtggttgtggacctgccggacacccccttcatctttgagcacaccgtcaacaattccacagctgtgatttcctggacctacgccttgggcaagcagccggtcagtttctaccagctcctgttacaggaggtggccaagacacaggagaatgagttgcccgaggcaaagaatcgtccatggatcttcaacaagattttgggcactactgtcaagctgatggagctaaagcctaacacgtgttactgcctcagtgtccgtgcagccaacacagctggggtggggaagtggtgcaagccctacaaatttgcaaccctggccactgacttcagcagctttcctgagaactaccccatccagatcaccgtgcggcgcaaggaaccccggcaaaagatcgtgtccatcgggccggaggagatgcggaggctggaggatctggaatacctatttccctgttaagggggagggccccaggacacccctcacctactttcagcttcaaccccaggccctcagaaaccagagccatgagacctaccataccaccagcaccctgcgggcccggggtctggcagagtggtatgggcaccccacccctgggctggggccaaggctacataggggccccattcacctggaggcatctcaggccaggccatgccaggctcagccactgcccacagctgctagactccctcctcctccaaatctgggctgggtctaggtccctcattaaagaactgcaggtcatccagca

SEQ ID NO: 134500 - DNA, 2125 bp, Homo sapiens
  Payload ID: 6276
  Gene Symbol: FNDC9
  Gene Name: fibronectin type III domain containing 9
  Uniprot ID: Q8TBE3
  ENST ID: ENST00000312349
  CDS Start-End: 189-863
aatgatgctgatctgaagaaatgaataatgtgagcattaggggcggcagtgggattactcagtgttgagagaaacaacacggaaagcccagagcagaggagggagaaggccccattctctcagctttaatctactgcacctcggagggcagagctctaaccagacacgctgcaagcatcagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaaatgtgtctatagactacccatttctctcccatcaaacgtcactgctattgtaggtcacctgggttggatgaatgccccatgacaaagcttctcaagctggaaaatgtatcccccagggtatgccaaggcacaaacgaggcatctcagcagcagcgtccactcggaggacacagttaagaattgaaagcattgttttaacattaaaacaaacatggatatgttataaagtagaaagcaaaaatttgcatgacaaataaaacacagcacttgaaggaaacacttgagttacaagtaggctctcagaggtacacttttgggcaaaggtagatgtccagtttcctctgcccttgaggggattatttggaaataatttgggattatttggaaataatttgtgagaacccttgctctggagtgttttccaacttttaggcaatcacataccaccgctctctattttttaaaaccatggattatcttcactattattaataatactttcctttaaattgactcattttttaagcgtaaacttattttcaaagacagccttatattactccataagtgaaaaaccagcaccctcctgctgcaaacagaagggaagagacataagaataaacatcatgaaaacaagataatattaaataatctgacttagcttctattgcctgccagtgattctgagcttaatgcctgcttgcttgtctttgataaaaagggagatccagtgttggagaggtaataaagacatattagcaccaatatttgtctttctccttgatatagcataaggtttgaaagagaatcgaaaagggaagtgctgtttttactttgcgagtcagtgttagttaaatgccatgtctgtgaaccacctcaaatgctgtcagtcagcttcccttgatttgagaaaattgtcttgaccagactaggcaggctgttctggagaagacgcctgtactctccaagcatcatccaagaccttcccagtaccctcttatatctatagagcacaaaatcccagaatcacaggacgacactgcagtgaatcaactaagaaacagcaggagctgagaagccaagacgagaagccccacatccctattcccttgcctacctcatgcattccctgctcggcacccagacttttgcccccattcctgctacttgtgaacaaataaagattcatatactca

SEQ ID NO: 134501 - DNA, 732 bp, Homo sapiens
  Payload ID: 6276
  Gene Symbol: FNDC9
  Gene Name: fibronectin type III domain containing 9
  ENST ID: ENST00000520782
  CDS Start-End: 192-732
aaccagacacgctgcaagcatcaggtaagacatatagatggctcttcttggaaatggaaatggcttcttttcacactctgcttggagaagggccgggcaaatgaatagttaaaaataggggagaatttagaaacggaaacagaggaagaaaaatcaataagggagacggacctggtcctaaaagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctgg

SEQ ID NO: 134502 - DNA, 2811 bp, Homo sapiens
  Payload ID: 6277
  Gene Symbol: FBRS
  Gene Name: fibrosin
  Uniprot ID: Q9HAH7
  ENST ID: ENST00000287468
  CDS Start-End: 264-1646
ccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacataatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 134503 - DNA, 5200 bp, Homo sapiens
  Payload ID: 6277
  Gene Symbol: FBRS
  Gene Name: fibrosin
  ENST ID: ENST00000356166
  CDS Start-End: 1089-4031
gagagaggaaggaggcgtaggctgaggaggaagagggaggaggggtagggaagtcctggcggagaagcgccctaagactccaaaggagacaacaggagtttgtgctggagctcccccgctgcccatcggccgttccggatcccctaaggcccaagtcggacagagacggaggaaaggaggaagagacttttatgtcggcggacaggggagctgtacccgtcaccgttgcctcacatccggggctttggagggctggcctcgctgccccgccccgcctcgcgcctttcatggcgaccggaggcggaggctggaggagctgggcccggaggaggcccctttaaatctccttaaaggggtggccactgaactcggcggactgcaacgccagccttaaaggggaagccgccgagcagacgctgacaaattgagaactgtgccgttgggagaactggggcgagtggggtttttctttacgtcctcctcccccacacacaagaagtcttttaaattcaacttaaaggggaagtggccgcttgtggaggactagaaactaactccgagcccttaaagggacggcctgctgttagaaggaccctggactccttaaaggggtggcctctttgagccggaggacttgagacacttttaaaggggaggtctgcgtttcggggcgagctttcggccccttttaaaggggtggcccttcctcttcctcggggagacttgcatcgacccctggcagggggtggccaccgcactaggccgccggacactgtcgggtcgtcttaaaggggccgggagctggacaacttggggcctcgccttaaagggacggccgccccgttttcgccgtcgcggccccgccgagcccgcagggggggccctcgggcttgtcgccccgggggcggcgccggctccccgggccgtggccttggggcaagctcggggccagcagatccggctttaaaggagaagccgtggccctctcgtcactgtgcagccgccagcgccgcgcctgcgaccccgggcctgcggacaggccgcttcgggccccgccgcctccggatgcggcgctgagggcggtcgccatggagacggcagcggccgcggccccgggtccgggctgggcagcagagggggagcgccgacggcggcgctgctcgcgccgagaccgagaccgggagcagcggcgccgccgaggtccaggcggcgacgcgccccgggccctgttggccgccccgcgcggctcctcgtcctcgtcgtcgccgccgccgcccgccaggccttggtcgtcagcttcgtctggagagcggcctgggggcccgagacgccggcggccccgtccgagacctcgacccccgcgaccccgagctcggaagcggcctgccggctcgggcagccgcggggaggaagaggaggaggaggaggaggaggggggcgcagacgacggcgaagccgaggaggagcctgaggaggaggaagaggaggaggaggacttgatcgatggcttcgccatcgccagcttcgccaccctcgaggccttgcagaaggatgcatctcttcagcccccagagcgactggaacatcggctgaagcattctgggaagcggaaaagggggggctccagtggggccaccggggagccaggggacagctctgatcgagagcctggccggccccctggggatcgggcccgaaaatggcccaataagcggagaagaaaagaggcgtcctcccgtcactctctggaagctggatacatatgtgacgcggaaagtgatctggacgagagggtctccgatgatgacctcgacccatcctttactgtctcaaccagcaaagcctcgggcccccacggcgccttcaatgggaactgtgaagcaaaactctccgtggtccctaaagtgtcgggcctggagcggagccaagaacagcccccggggcccgacccgctgctagtgcctttccccccaaaggaaccaccgcctccaccggtccctcggcctcctgtctcaccccctgcacccctgccggccactcccagtctgccacccccaccccagccccagctgcagcttcgggtctcacccttcggcctccgcacttctccatatggcagcagcctggacctcagcactggcagctcttcacggccgccccccaaggccccggcccctcccgtggctcagcctcccccctcatcatcctcttcgtcctcctcctcctcatctgcctcctcctcgtccgcgcagctcacccaccggcccccgacgccctcactgcccctgcctttgtccacccacagctttccccctcccgggctgcggccccccccaccaccccaccacccctccttgttctcccctggccccaccctgcccccacccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacataatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgagacccc

SEQ ID NO: 134504 - DNA, 2890 bp, Homo sapiens
  Payload ID: 6277
  Gene Symbol: FBRS
  Gene Name: fibrosin
  ENST ID: ENST00000543786
  CDS Start-End: 1-632
aggacttgatcgatggcttcgccatcgccagcttcgccaccctcgaggccttgcagaaggatgcatctcttcagcccccagagcgactggaacatcggctgaagcattctgggaagcggaaaagggggggctccagtggggccaccggggagccaggggacagctctgatcgagagcctggccggccccctggggatcgggcccgaaaatggcccaataagcggagaagaaaagaggtctccgatgatgacctcgacccatcctttactgtctcaaccagcaaagcctcgggcccccacggcgccttcaatgggaactgtgaagcaaaactctccgtggtccctaaagtgtcgggcctggagcggagccaagaacagcccccggggcccgacccgctgctagtgcctttccccccaaaggaaccaccgcctccaccggtccctcggcctcctgtctcaccccctgcacccctgccggccactcccagtctgccacccccaccccagccccagctgcagcttcgggtctcacccttcggcctccgcacttctccatatggcagcagcctggacctcagcactggcagaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgag

SEQ ID NO: 134505 - DNA, 5568 bp, Homo sapiens
  Payload ID: 6278
  Gene Symbol: FBRSL1
  Gene Name: fibrosin-like 1
  Uniprot ID: Q9HCM7
  ENST ID: ENST00000434748
  CDS Start-End: 1021-4158
ctggccgaggaccctcccccggtcctccccgccccttccccgtcccttccacgctcgccgagggcaggacttcggttccgcgagaccggaggcccctcgtcctcctcggaagccgcccgcggccggggaccccagtcccgcagaggagggcggcgctgcccccgcctcccgcttggagagcgccgcccgcaggtgcccacggaggggccgcggcatcccagcgccctcccaggaaggagccgagcggatcaccgccggctgcagcggaggtcggggcgccggggaggggcgcggctagggggcgaggtcgaagggcgggcacctgcgggtggggcggggcctgaattagcgggagcgcccgggaggggcggggccggggcctgcgtgagcgggtcggggagggggcggagcctgcggggggcggggcctgcgtgaatggggcggggaggggccggagccttgtgagcggggcgggccgcgtgtgcggggtgggggcggagccttatgagcggggcggggcaggggcgtggtcggggcggggcgcgcgggcgcccgcggcggccctcacttcctctggcgagcgcagccgggcggaagtgcgtcagttgttatctgttcggggcgccgccgccgcctcacgagcccggtgcccaggagcccggccgcctcccgcctgccgcctgccgcgcccgcccggccccgcccgctcggcccgatcgccgcgccgcgcgcatggggcgcgcccccgggggggcggccgagggccgctgagcgccgggcccgcccccgccgatgcgcccagccgcccgcgccgggggtcccaggccgcgccgggcccggggctgagccgccccccgcgcccggcatgcccggcccggcccgccgcccgccgccgcccagggcccgagcccgcgcggcgcacactcagcccggcggcgccgcgtagccgagggagcccgcctgctgcgagccaggcgcggggcgtcaaggtcaccggcccgacggggcgcacgcgcggccatggaggccaaggtccgcccgagccggcgctcgcgcgcgcagcgggaccgtggccggcgccgggaggccgcccgcgacgcccgcgcccagagtccgtcgtcgggcgacgagcccgagcccagccccggcaaggagaacgcgggcctccgcggcgcgcccccccgaggcgccgcccccgcgccccgcaccgcgcgtcccccgcgccgccgccgccgcgagtccagctcgcaggaggaggaggtcatcgacggcttcgccatcgccagcttcagcaccctggaggccctggagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcagatgaaggtcaccgtgtccaaagggggcgaccgggacagtgacgacgacagcgtcctcgaagccaccagctcccgggacccgctcagcgatagctctgcgcatgcggtctcggggagaggctactcttgtgacagcgagagcggcccggacgacaaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtcccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 134506 - DNA, 2938 bp, Homo sapiens
  Payload ID: 6279
  Gene Symbol: FSCB
  Gene Name: fibrous sheath CABYR binding protein
  Uniprot ID: Q5H9T9
  ENST ID: ENST00000340446
  CDS Start-End: 293-2770
ataacagagactaaagaagaaagacgcttactgaataaggtgggatccaacaagagtgtagtatggaatgcaatagcttatgaattactttttttctgagggagctcaacagaatgacacctaagaaagggaaagtctttgacacttggtacgtttgtgatttttggtcattacttgaaaattaataagtttgaaatcactactcttagaaatggaagaaagtgatgactctaatcagcctatctcagcgtgtaggcaagaaattcgaaagagaagatgacccagcaaaccaatggtaggcaaatcccagcaaactgatgtaatagagaaaaagaaacacatggccataccaaaatcatctagccccaaagctacccatcgtattggtaatacttctggaagcaaaggcagctactctgccaaagcctatgagtctattagagtatcttctgagcttcagcaaacttggacaaagagaaagcatggacaggaaatgactagtaagtctctccagacagacaccattgtagaagagaaaaaagaagtcaagttagttgaggaaaccgtggtacctgaagaaaagtcagctgatgttagagaagctgctattgaattgccagagagtgttcaggatgtagaaattccaccaaacataccttcagttcaactaaaaatggacagatctcagcagaccagccgtacaggatactggaccatgatgaacatcccccctgtagaaaaagtggacaaggaacaacagacatactttagtgaatcagaaatagtggttatttccaggccagatagttcttctacaaagtcaaaggaagatgccctgaaacataaatcgtcgggaaagatttttgctagtgaacaccctgaatttcaaccagcaacaaacagcaatgaagaaattgggcagaaaaatatcagcagaacttcatttactcaggagactaaaaaaggtcccccggtacttttagaagatgagcttagggaagaagtaactgtacctgttgtacaagaaggttctgctgttaaaaaagtggcttctgctgaaatagagcctccatcaacagaaaaattcccagctaaaatacagcctccattagttgaagaggccactgctaaagcggagcccagacctgctgaagagacccatgtccaagtacagccatcaactgaagagactcctgatgctgaggcagccactgcagttgcggagaattctgttaaagttcagcctccacctgctgaagaggcccctttagtggagtttcctgctgaaattcagcctccatcagctgaagagtctccttctgtagagcttctggctgaaattctgcctccatcagctgaagagtccccttcagaagagcctcctgctgaaattctgcctccaccagctgaaaagtctccttcagtagagcttcttggtgaaattcggtctccctcagcacaaaaggctcccattgaagtacagcctttaccagctgagggcgcccttgaagaggccccagctaaagtagagcctcccactgttgaagagacccttgctgatgttcagcctctattacctgaagaggctcctagagaagaggctcgagaacttcagctttcaacagctatggagacccctgcagaagaggctcctactgaatttcagtctccattacctaaagagaccactgcagaagaggcctctgctgaaattcagcttctagcagctacggagcctcctgcagatgaaactcctgccgaagctcggtctccactatctgaggagacttctgcagaagaggctcatgctgaagttcaatctccattagctgaagagaccactgcagaagaggcctctgctgaaattcagcttctagcagctatagaggctcctgcagatgaaactcctgctgaagctcagtctccactatctgaggagacttctgcagaagaggctcctgctgaagttcagtctccatcagctaagggagtttctatagaagaggcccctcttgagcttcagcctccatcaggtgaagagaccactgcagaagaggcctctgctgcaattcagcttctagcagctacagaggcttctgcagaagaggctcctgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccccgctgaagttcagcctccaccagctgaggaggcccctgctgaagttcagtctctaccagctgaggagactcctatagaagagacccttgctgcagtacactctcccccagctgatgatgtccctgcagaagaggcctccgttgacaaacattccccaccagctgatttgcttctgactgaggagtttcctataggagaggcctctgctgaagtttcacctccaccatctgaacaaacccctgaagatgaggctctggtagagaatgtgtctacagaatttcagtcaccgcaggtggcaggaattccagcagtaaaattaggatcggttgttttggaaggtgaagcaaaatttgaagaggtttcaaaaatcaattctgtccttaaagatttgtctaataccaatgatggacaggctcccactcttgaaatagaaagtgtttttcatatagaattaaaacaacgtcctcctgaactgtagtcaggttgtacctaagctagcaatcagaagctacatggttttggaagaacatactttagaaaagggtgggcagcgggaagtagctttgtcaataaggcaaattaaaggggaccccaagacttggaatacaggttggaaaatgaacaataaaaactgtagcagcataaa

SEQ ID NO: 134507 - DNA, 2805 bp, Homo sapiens
  Payload ID: 6280
  Gene Symbol: FSIP1
  Gene Name: fibrous sheath interacting protein 1
  Uniprot ID: Q8NA03
  ENST ID: ENST00000350221
  CDS Start-End: 211-1956
ggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaagtctgcaaaatatagtgaagcttggcaaagtaaagaggagatggaaaatacaaaaaaatttttatctttgactgctgtttctgaagaaactgttggtccttctcatgaggaggaagacaccttttcctcagtgtttcatactcaaatccctccagaagaatatgaaatgcagatgcagaaactcaataaagattttacctgtgatgtggaaagaaatgagtcattgatcaaatcaggaaagaaacctttctcgaatacagaaaagattgagctcaggggtaaacacaaccaggattttattaagagaaacattgagttggccaaggaatcaagaaacccagtggttatggttgacagagagaagaaaaggctggttgagcttttgaaggacttggatgagaaagattccgggctctccagttctgagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcagaaacctgaccgtgatggtgaaagaaatatggaagtaactccaggagaaaagatacttaggaacaccaaagagcaacgcgatctgcataatcggctgagagagattgatgaaaagctgaaaatgatgaaggaaaatgtgttagagtccacatcatgtctctctgaagaacagttaaagtgtcttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttggcattgggagactgaaaaggccctccttcttagatgatccactgtatggtatcagtgtgagcctttcatcagaagaccaacatctgaaactcagttctccagagaatacaatagcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaagatgagctactttaaaagacagtctgcggtactatttgaagagagatggtttagttacaagtcagtaacttagattcatgagaaaattttgtgttgacattccataagatgagttggcattagaattggaagtccagtttatttctgaatcaaaaaatgagcgggctattgtgctgcctttaataaaatttgagtgatgtatacataa

SEQ ID NO: 134508 - DNA, 103 bp, Homo sapiens
  Payload ID: 6280
  Gene Symbol: FSIP1
  Gene Name: fibrous sheath interacting protein 1
  ENST ID: ENST00000559547
  CDS Start-End: 1-47
atgagcaggagactaaagatgcagcagaagaatgtaaagaaccctaatcaaggacttgctgggtgtgcttttcagaaagttgagtttgggccttttagattgc

SEQ ID NO: 134509 - DNA, 21054 bp, Homo sapiens
  Payload ID: 6281
  Gene Symbol: FSIP2
  Gene Name: fibrous sheath interacting protein 2
  ENST ID: ENST00000343098
  CDS Start-End: 1-20991
atgaagtttcaactgtggtcctctcagatcaggcctctcggaccgattttcccagctctgcgggcgctctacgcgctggcgcgagccgcccctcaggaggccaccgcccttctggggccgctaccattggaagcctggaacgcggggggcggggctgaggtcgttgggctctggccattcctggtcaggtccggacagagggacaacggggtgctagagaaggagagcggggcgggtgaggaaggggctgagggggctgtgccggccatggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacagtttttagtgaggaaaagatgtctgtttctacatggtcaaggaaaaaatatgaatcaaaacagttcctaagaaacatatacgatgattcttcaatttatcaatgttgtgaacatctcactgagtcagtactttaccatttaacttcgagcatttctgatggcaccaaaaagggtagagaaaaagagaaagcatgggaaattcaagaagcaacatttagcaagattatttcaattcattctcaagtgtttgagagcaggtcaatttccattggagaacttgctttatgtatttctgaaatcattattaaaattctttttaataataaaattatacaggctgacattgcacagaaaatggttgccatacctacaaaatacacttactgtccaggaatagtttctggtggctttgatgacctctttcaggatctcttagtaggagtgattcatgtactgtccaaagaaatagaagtagattatcactttgaaagcaatgtaagaaacaaatcattttctatgcatagaaataatagtgtacccctttgcaacaaaatcaatagacaggcaagccccagagactggcaattttctactcaacaaattggtcaactttttcaaaaaaataagttaagttatcttgcatgtaagttaaacagcctggttggtaacctaaaaacaagtgaatccaaagaagtagtcaataaagtttttaatattgtttcagatttattttcaccagatgaatgcctagatacgggtatggattctggtaaaatacaaagaacatatttctactcctcgaataatgagcaacctaatagcatacttaccaataacctacagctctcctcaaaatcagtttttcttctcaatgttgtatgtgagaaacttatcagaatacttttggaagaatgcacaagcactgcttttcctgataaagggtctgtttcagaggaaacatcagcagaagaatgtcaacttttaaaaatgcttcaaagtgtagaagatggaaaatctgattatcgtaagggaggaatggactgtgaatgccttcaagtagattacatgtcagaccttttggagaatgtggcagaaattgatcaagacttattgacatcagactctatgcttactattatttcccacagcttggttaaatcattgatggacaaattatctcacagcatacaacaagctccggaaagtctaccttttgcaaataagcatttgaactacagaacaagagaaatacagtctagtttcataaaagcaagaaagtcagaattaatagaattaggacagagtaaaagttctttagaactcaggagctatgatagtaattctttgacagtatccctgaataatcccagtgtggttagctccaaaatacaagcaccatttaacaagcattgtgcagtaaaatcctcttctgtgtcaccttttgaaagacagagaacaaaggaaatggataaggtagccattcataataagctacatcaggaaggtatatatgctggtgtttattcagccacatttttggaaggaataatttcagaattgttttttaatctctctatgtcattgtggggcaaaaataaaaacatcactgtgtcctggctcaatgagatgaatacattatttgtcaacaatgtagtgaatgaatttaataatgctcaagtcactgttctacggaatgctgaagaaaggctgtgttttccaccagttcatacagaaactgttagcaaaattgttgactcagtttattatgatgttttacagcagtatgaattaaaagtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaacctaacagaatttacttctctacccaggtcttcatcagactatagtaccatgttatcacattcatttttagaagatgtcataagaaggcttttatctcagctaattcctccacccattacatgttcctctttaggaaaaaaatatttaatgagttctgattttaatgaaatgtccacttgtataataaataaggttatgtcagccatttcaaaacataaaatctggttcactatatatgataatcaatatctatatactggaaaaaacctccaaaagatggtggattctgtatattgtaatattttgcaaatgtctgactctcttgtttcaatacaaaaaagtatagtaagccgaagcccaattatgattgaccaaatagccagctttatcatccaagagattatcgaaaatcatcttcaaccatttttgagtggagaggttttatgtcatccaaggactccactggatccagtgtctactattgttacacaggttctgagtgaagtgatagagtcacacagacctcagaagcaatcacctttagatattcaccttgattcatttgtaagggagattgttgccagacttttgtcaaagattttcagcccaaagcataacactgaaattgagttgaaaaacatgacccaaagaatagtaaactccataaataggcatttcaataaagctaaaattcacattctctatgatgacaaagaacaggctttcttttctttcaatacagatattgtggatgaacttgccacctcagtttatagaaatgctttaaagcagcatgggctagaccttgctgttgataaagagtctgaagacagtggcatttttgtggaaaatattaccaatttaattgtagcagctatttcagattaccttcttcatccactgttttctggggatttttcagcttctacctattctaattcagtggctgagaatattgttcaggacatccttagtaacatcagtaaatctactgagccaagccagagtgtacctctatataacaccttgctgccatacacatttttagaagatatgatcagagtactattatctaaattattttcttctgcatctagcctggttctaaacagagacacccaaaaagatatatcaagagtgaatttcaatgacattgcttcaaacctagttagtgatattaggatgaaagtttcccaacatgaaattcgattttcaaaagaggaagaagaaaccaagtttatttattcagaagatgatattcagcaccttgttgattcagtatttgcaaatgttgtgcaaacctctggttctcaagaatcagctgtgcaaaatatcacaagcagtaatgacattcttatagatagaatagcaggtttcatcattaaacatatctgtcaaaaacatcttcagccatttgtgagtggaaaatcattatcttcatcagacacatattttgatgatgagagaaggcagttattttataccagtgtttactcttcaacattcttggaagatgtaatctctggggttttaagaaaaatattccacagggtagtaggcattgtacaaacaaaatccataagagattcagaagatgaactgtttgagaaagctgaagaactcatacatttgattacaggggaattctcaaaagcccaagttagcattatagataatactgaggaaagactgtgtttacctccagtggagagggatgtagtcaaaacaattgttgacatggtgtacagcaaagttttgcaagaatatgaaatggaagtcgtgcccaataaagattttctaaatgacacaaagacattggctgcaagaataactaatatcatcctggctgaaatttttgatttccaaattcatccagatcttatagcaaatctgccttttaaatcacattccaaactcagtgcaaatgttttaatacaaagagttcaatatgatataagtaaatcaagattccaaagacaagcttcaacaatgtataccactatgttatcacatagtcatttggaaaaaatagttactcagcttacatctcagataagtccattgaacaccagtgcagagcagtcagatactactaaatcagacttaagtaatacagtgataaaactgataaatgaaattatgtcaataatttcaaaacatgaaatatgtattattaaatatgggaataaaaaacagagtatgatttcagcaaaagatatccagtctatggttgattccatttatgctgatctttctcattcaaatatataccagtccattacaaaagataaaaagagcataagtgacatacctgtttcaaaaatagcgagttttataataaaagaaatctttaaccatcatattcaatcatttttatctgaagataaaactctccttttggcagcagttgatcaaacttataaattgaaagcaatagatcctaaacaaagagaattatcttttattgtgaactcatctgtctttttggaggaagtaatttctgagctcttatgcaaaattctttatgcattttcacataacatgttggttactgaaaatccagatagagtgaaactgaaacttaccaggattgttacaacattggtaaattcaattgttctggagttcaccacatcagagattttagttgcagataactttgataaaaatttgtgtttctcagaaagatacaaagaaatggttcaaaaaatagtcaactcagtatatggaaaagtattagatcaatataaatctctgattcaaatacatagggttatacaaagtgacacaatatgttttggtaggaaaatatattatttgctattggaagaaatatatgattatcaagtgcagtcattagtttcaggagaattagagtcttcttcttattcgtatccccaagctgataatatcatcagaaatgtgcttaacataatcacaaaggatagccatgccttgccaccatatattactgtgttgcctcattctcttttagaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 134510 - DNA, 3869 bp, Homo sapiens
  Payload ID: 6281
  Gene Symbol: FSIP2
  Gene Name: fibrous sheath interacting protein 2
  ENST ID: ENST00000415915
  CDS Start-End: 1-2920
gtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 134511 - DNA, 2726 bp, Homo sapiens
  Payload ID: 6281
  Gene Symbol: FSIP2
  Gene Name: fibrous sheath interacting protein 2
  ENST ID: ENST00000429412
  CDS Start-End: 1-411
aaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatggtgaatgacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggtaaatatcagcagtaattattgagtaaatcttgcattctatttattctttcaactgacatttactgagtttttgcttcatgttagatatggtgctaagttttaatcattcaaggaaaaatggcacaatttttgctcagggttcttacagtatacttggaaagatagtcatggcccaatatgataagagcaataaaggaagtgggtatgtgtaaaagctgggaaagttatgggaaagagaatgcatagacctatctagggtcatcatagaagcctttataatttagaaagagactgcgttgagacatgaaggatcagaaggaatttcctattttctttttgttatttttattgtttgtactaatgttgacaaccaaaatttgcaaaaaaattaaagtttttgtactcatatccttatacttactgttttctgcttttacagcagcttctctcccacaccacaactttattaaggtatagtggataatttaaaactgtatatattgacggtacagatggtccccaacttgtaatgattcaatttagggtttttcaactttactgtcggtttattggggtattaaatgcattctcagcttacaatatttttgacttacaattggctaatcaagatgtaacaccatcataagacaaggagaatcatatacaacttgatatgtgtatatacagtaaagtgttcaccacaagcaagccaattaacatatcctcacttcatgtagttactatttgtgtgtggtggcagaagaacacttaagagctactctctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgaattggtgatgcgggctcttttttggttccatatgaactttaaagtagttttttccaattctgtgaagaaagtcatcggtagcttgatggggatggcattgaatctataaattaccttgggcagtatggccattttcacgatattgattcttcctacccatgagcatggaatgttcttctatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataacctggatcccttccttacaccttatacaaaaatcaattcaagatggattaaagacttaaacgttagacctaaaaccataaaaaccctagaagaaaacctaggcattaccattcgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaataaccagaatctacaatgaactcaaacaaatttacaagaaaaaaacaaacaaccccatcaaaaagtgggtgaaggacatgaacagacacttctcaaaagaagacatttatgcagcc

SEQ ID NO: 134512 - DNA, 20788 bp, Homo sapiens
  Payload ID: 6281
  Gene Symbol: FSIP2
  Gene Name: fibrous sheath interacting protein 2
  Uniprot ID: Q5CZC0
  ENST ID: ENST00000424728
  CDS Start-End: 1-20724
atggagctgtacctcggcgcctgctccaagcctgccaaagtcgccgtcaccaagacggtcgccagcgtcctggccgcggacacccagcagtgcagagacggcgtgcacaaaacccactttgcaggggttggaccggctcagctactggacctacctctcggggtcaagctgcctgtgatcccaggaagcaatgctgtattctatactacgaatttcggtgaaaagctttttcgaccttcttatggttttaacctgactgatccctattgtcgacttttggaaaaccaatataaaagcctccatgatccacatttaaaagcatactataagcgcaaagatattttgaagagattaaagaaaggtggctacatcaccagcaataataaagttgtatgtaccttgagagaattgaataagtacaggcaatatcttaccagtttaaaattagactttgagagaaactatataaaagaacaaagaatacttgcaaaacaactacataacataccggaaaacaatcaaatccctcaacattgtgatgttgcacaagtccaaaactggttgttaaaggagggcactgaatctattaaggaccaggagcggctgatgaggcatagatatttggatatgataagtagaaaactagaacaacttgaacgcacagcagaagaacaacgcctattcctaatggatagagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaagaaacaagatcttctagagaaaaaaatggcttatcatttacaaaaaatgcaagatactggctttaacggagaagatataggaaaaaatacatttaaatacagaggtcaagatggaacacatgcttctccaaagaataaaaagaagacttctgaagatataatgttagtttatcctgctggagaccagaatacatataaagaaacacatggacatacagcaaatgctgctcatcagcgtcaaaatagttcaaataattttacgaaaaaaaactcagcttctgttgtttatcaggcagatgtacaggataatggtataaatcaaaagagagatgggatggtatctaaaaactcaagtattttcgatgatagaggaggtataaatatttcaggccaaggttcaattatttcagcgcaggtatcacccacgagaaatttttccagagtttcacaggcatttttggatccttcaaaagaagagaaggagacaaatgctgattgggatggaagaccaaccaagagatcaagctatctctgcgaatcaggacctcaggctcatgctacagacccgggtatattttcttctcctgtttacacaaatatgcaacagaacttgctgcaaaattgcttgcaagaaaaagtaacttctgaagaactgaatattataattcagaatgtaatgacctgggttgtggctacagtgaccagtatattgtacccagccatcacaaagtatgaaaaaagattgcaaaataatacatacccagtatctgatgactccatcctctcttcagatagttcaagtttctgtagcacgtgcagtgaagactttacatatagaagctacacatctgcaacaactaaaacatttcaggcagaaccctgtgcatttgtagttgacacgtcagtaaggagaccaaccacacctataaaacctcctcctgcacatgtggaaaaaacagttgtggggaaaacatgtcacataaaaggacaatctataatctctaaacataaatataataaaaccaacttgctatattcataccctaagctcagaagttgtaaatcagatagtcaccttttagcatcatttgaaacaggcacaaaaaaatctaaggatgctaccactgaaacagatagcttagggagttcattgcattgtgataaaacagcaaaagccatggatgaaatgaagaatttaaaaaatgtttttgttaactttaaatgttacttgaaaggggaaactgaagtgattttagaaagcattttgcgagaaataatgtctgatttaacccaggccattccctctctctcttctgttactgctgaagtttttgttgaacaatgtgaacgtgaaaaagaaatcttgctttccaatgctcatattccctcagttgcttctgagattgtggaaaatatgcttgagaagttagagtctgcagttgagaaaaaatgtgttgagatgttttcacaagatttgtcagtcgacattaaaccaagtttagcagccagtgatgaacttctcacatcatctaatggaaaacctttgaaaaattcaatgcctcatactttggacccaatgtgtgatattgcagaggacatggtgcatgccattttagaaaagctaatgactcttgtttcttttaagcaaaatgaatttcttcatcttaaagacacaaataagctttcctgccagcaacataagacagacccaatatgtatgttccttcaaagagctggcaaaaataaatctagtcttgaatctgatgaagctagtttaattgtcaatgaagaagtacaaaatttaatatcaaatattttttcccagtcttctttggttgcttatatagaggaagcaatcaatgctatactaggttatatacaaactgaactaaataatgagagaattattgcatctgaagaaaccgtagtactccttcagctacttgaggacatcctttttcagctccatcaggaaccagtaaatgaaagttttcaaaaaagtaggcaacctagaataagtagtccttctgacaccaaagaaaagtacagactcactggcactagattatcaaatagtcctaggtctggaagaccatttccacctataaatgttccaggcatggttctttattctgatgatgaaaatgaggaaatagacaatattgtaaaaaatgtgcttgattcaactttcaaagatgaaaaagtaaaatcacaagaacagattcctaatcattggtttacaaagggaaacacttgttttgaatgcaaaagaaatatcaaaccacctacaaagcctggttctagaagcaaagctgcatttcatgattgggaattaaagactgagccaccatctactaatcatgaagatattttaaagaaaaaactttcttcgaataaagacatttcaactttcagccaagatcaaaagcatcaaatagaaaaggcttcagaaaacatagtcacaagtattttaaaggaaatgctcaaggacatatcttccgttccttttggtcacttagacagcaaaactggcagtgaagcttcagttcttgtttcagaaaagcctcaaggactgtcacatcaagaatggatagaccagatgttttctgtttcagaaatcagtacagtggctcaagaaataacagattctgtgttaaacatacttcataaggcatcaaactacatttccaataccactaaaagttccatttcatcatcagttcatcagatttccttacataattctgacactgaacacatagtcaaagaagcaccaaataaatacccattaaaaacatggtttgacagtgaaaagaaaatgaaatatttatctttatttgacgttgatcctgaaaagcctccctggttaaaatctggaaaaagtgaacctaaacctgtagatgacattaatgataagatcattcgtacaatttttaaaagactgaagtcatttatttgtccaaaattgcatatgggcttcaaatcttcattacgatctcaacttagtaagtacacagctaaaatagtaaacattgttttatgtgctatccagaatgaactggaacttcacaaggaaaacctaaatcttagggagattgaccataccaaatcccttacagataaaggattttttgctaatactgataaaaaattagaatctcttgtcacgagtattgatgatgacattttggcgagtccattattaacctgtatttatgatatgttgttatcaagtgaaaatgcacatcaaagaagcatttcactctcttctcgtaagccaaagtctgcaactgacagtgttgatgtacaaagcattttgccaaataggcaagataaaaaatcttttcacaaatatttggctactccttgtactcaccacagtgtcaatggtggaaaccatattaaagagaatgcaaaattgcaagtgttagaaagaattggggaaacactacatgaaatgttaagcaagctcctggggacccatcttcattctcagctatcttgtagtcaacaaagcagagagatgaccaataagaatcagaaaatggctgctgcattgcagtctaatattcagttaatttctaaagcaattttggattatatccttgcaaaattatgtggtgttgacatggataccagttttgcaagttgtggattaaaagctatctcagagtctcttgacattgacaacccatcatttgcttcaattattgagaaaatggccaaatccaccaaaataatctccagcatagtttccagaagggttcaggaggacaataaagaagagactaaaagcaaggcaaaacctgttgctcctgtgtcttccaaaacaccaagcacaaaagaaatgcatccaaataaactaaaagctgtagcttcagatattcttaatatggtttttgctaaactggaagggtttgccaacggacatttagaaattttgggtgctattaatgatggaaataagaaaagcaataagataggctgggaatatgaaagcaccaatatttccagagacacacatgaagcatcatttctgtctgctttatatatgcatgcaaagaaggtatcaagtgctattttgaaggttattcaaacagaattaaatgtgacctcatcagatttgaagacaagtgtagaaaacccaccacctgagactcaaatacttaagtatgtagtcaagttaattttagatgcagtatcttccgatatgtttaatgaaatggaatctgaagggggaggcattgaaacttatcgatacaggccaacatatggaagtcttcctggaggagctgaatcagattcatttctagaagatgatgcatatacagcgaaaaaaattattgatgagagatccccacaaagagaagaagtgaaaacacgttctcttaaacaatgggctctcgaaaaaaccttaaacaaaattgaagtaaaactcaaagaaccacatatatctccaattgctcccattataagaaatattttgaatgaaatttttcaaagtactttaatcaatcaattaaatgtcctttctctctcccactctaattttaatggcatgcctcacaatgttgatgagccaactccccaaacatctgttcaatttatggataaaatgatggatcctttactttcggaagcagatataaccatagtaacagataatattgttaggactgtatttcacaaactttattcagctgccatgacagaaagaaatgtaagggaaaataggtataaaactatcactttttcagcaaatgtttcttctcatgaacacacctataaaggaaagtcctctgtcacggctttggatgaaaatccatgtacttttcagtctagattcagcgttgctgacaaggagacaaaggtaaatctagctgaagatattgtacaggcaatattaacaaatttagaaacttttgctacttccaaagtaaaatctctcttttattctcaagtcaactttacagttccagtggctttacctattcagcaagatcacagtacattgagcaaagcattatcagccaaagattcatattctgatgagcaattttcctgttgctcagtagatcataccaagtcaggaaagaccaacttgtgccaactgtctttgtctaaattaaatacttatgcactacaagtggctagaagaaatttacaaggaatcaaacaggaattagataaagaaagggaaaatccttttttaactcatgacattgggatttctgaaagtattgcaagtcaaattgttaacgcattgttagacattatatcacgtaaaggcaaatgtgacaaaaacagttctgacaaagagatcgatttagatcagcaaaaaggtgttattgaaaagctgctcaatgagaccaaatatcgaaaagtacttcaacttcaaatacaagataccattgaaggtatcctatgtgatatttatgaaaaaaccctgtttcagaataatctctcatttgccacacccactctgaaatgtagcatagctgataaacattcagaagaaaattctgaaatgttcatggagggtgcaaataagattattcctaagctttcagttcctaaatcagatgtcattttgatatccaatgatatagtgaatattgttcttcataatctcagttctgctgccacgcttgtcataaatgcaaagaatcctacttctgcaagattgcccctgacattttgtgatacgtttccaaaaatagactgtcaacagcctcttaaggggtcaaaaactgaaagaaaaacagagcgtttttcatattcaagaaatcagaaatcagcttatgctgatgataatcagataactgtagtagagaaagaagacactcagaaatctgctactgactcatgtgaggaaaatgctaacttcattactaaaactatttttaaacgtttggaatcttttgccacagaaagaatagattcattaattacccttgctttccaaagtaaagaaaagtcatttgttatcccagaattggaaaattgtaaacaaaatgacagcatcttttatgattcaagccaagtggaatcagatgtaaatgtcctgaaaatatcagcaactgaaaccattctcagccaagagcttacagatttcacttttgttggtcgcagagaaaaacttggatccacaattcacctatcgcaagctaggcttaagacatatgctgacgtcattgccagtgccattttgaagcttattaaaaatgacttagacttagaaattcaaaagatatatccatatcaaaacaatattttgttccaagaaaacatcattgtgagtgaaattgttgacagtatgttaaagatgttagatgataaaagatctgtaaaggaaatttgttttaattcaaaagaaaattctaacttttcacaattagctttatcaaatgaaatattgctgggtcacaaagagaaggaaagaagtaccaaacaatctctatttacaaagtatccattagagcaaaaccaaatgatattggaaaacaaaaggcagataattgttttggaagaaatatttatgagaaatggagaatcaaaaaacaaagaaaaaggtgaactgctcattgcagtggaagaacttttgaataagttgtatcaaagagtaagggaagtcacaggccatttgcctccacttaatgaaactgccaactttatatctaattctaagattaaaacatcagacacaacacagaaaaacagttttcaatcacatattaacagtgtagcaaatgacatagttgaaagtgttttggggaaaatgtacttggtagttgtgacatcattatatgaaaataataaaagtaggacagaagttgaaatatctgaccacaatgattccttactaatgaaaccattaaggtttagagaaactaaacaagcaggaaaaataagtaattcccctagatatgcgatatcacaggcttattcttatgtcgacagtcaaaatatctctgtgatggaaaacactcttttgccatatttaccattgcaagtgaagaaagacttaattcaaatggttctcaataagatcacaaattttgtctcacttcctttaaaggtgagccctaaggacaaccctaagccatgctttaaagcacatttaaaaacaagatcaaaaattaccactttgcctaaatttacaaaaaaaacacacttaggactgagtgctgctaaggccaaaagcaaaaccaagttaggtcctggagagaagaccctaaaagacagcagatccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattctctttcacttttaaatttgccccctcttgagaattgtgaaagcaggttttataatcattttaaaggagcttctactagagccgaggatactaaagcacaaattaatatgtttggaagggaaattgttgaaatgctacttgaaaaactacagctatgctttctgtcccaaattcccactccagatagtgaagaaactctatcaaacagtaaagaacacattactgctaaaagtaaatatggttttccaaacaagcatagcctcagcagtttaccaatctataacacaaagacaaaagaccaaatttctgtgggctccagcaaccaaattgttcaagagattgtagaaacggttttaaacatgttagagtcatttgtggacttgcagtttaaacatatctccaaatatgagttttctgaaattgtgaaaatgcctatagaaaacctttcttctatccaacagaaactgttaaacaaaaaaatgttgccaaaattacaaccactgaaaatgttttctgataaatccgagtcaaatactattaatttcaaggaaaacatacagaatatccttctacgggttcattcattccattcacaattacttacatatgctgttaatatcatcagtgacatgcttgctgtaattaagaacaagctagacaacgaaataagccaaatggaaccatcttcaattagcatattgaaagagaacattgtagcaagtgagatcattggcacactaatggaccagtgtacttatttcaatgagtctttgatacaaaacctttcaagagaaagtttgttccaaggagctgaaaatgcctacactgttaatcaggttgaattagcaactaatatgaaaatgttcacatcaaagttaaaggaaggtagtttggggattaatccttcacaagtgagtaaaactgggtttgtgttttgttcagatgaagatatgaaagaaaagtacagggtttcatcagatttacccacctctgtcagatcctctgtagaagacacagttaaaaactcagagccaacgaaaaggcctgattcagaaactatgccatcgtgttctactagaaacaaagtacaagaccacagaccaagggaatctaactttggtagttttgatcagaccatgaaaggaaatagctacctccctgaaggcagtttcttacaaaagctgcttaggaaagcaagtgactccacagaagcagcattaaagcaagtcttgtcattcatagaaatgggaaaaggtgaaaatctaagagtgtttcattatgagaacctaaaaccagttgttgaaccaaaccaaattcagacaaccatttcccctctcaaaatatgtttagctgcagaaaatattgtcaatactgtgctatccagctgtggctttccaagtcaaccacacactaatgagaacagggaaataatgaaaccatttttcatatcaaaacaaagctctttatctgaagtatctggagggcaaaaggataacgaaaaaagtttgcttagaatgcaggataaaaaaatcaactatatacctgaggaagaaaatgaaaaccttgaagccagccgggaagattcttcttttttgcaaaaattgaaaaaaaaggagtacccaaagatagagactgtgaaggaagttgaagcctttacttttgctgatcatgaaatgggttccaatgaagttcatctgatagcaagacatgtcaccacatctgtggtcacatatttgaagaactttgaaactacagtttttagtgaggaaaagatgtctgtttctacatggtcaaggaaaaaatatgaatcaaaacagttcctaagaaacatatacgatgattcttcaatttatcaatgttgtgaacatctcactgagtcagtactttaccatttaacttcgagcatttctgatggcaccaaaaagggtagagaaaaagagaaagcatgggaaattcaagaagcaacatttagcaagattatttcaattcattctcaagtgtttgagagcaggtcaatttccattggagaacttgctttatgtatttctgaaatcattattaaaattctttttaataataaaattatacaggctgacattgcacagaaaatggttgccatacctacaaaatacacttactgtccaggaatagtttctggtggctttgatgacctctttcaggatctcttagtaggagtgattcatgtactgtccaaagaaatagaagtagattatcactttgaaagcaatgtaagaaacaaatcattttctatgcatagaaataatagtgtacccctttgcaacaaaatcaatagacaggcaagccccagagactggcaattttctactcaacaaattggtcaactttttcaaaaaaataagttaagttatcttgcatgtaagttaaacagcctggttggtaacctaaaaacaagtgaatccaaagaagtagtcaataaagtttttaatattgtttcagatttattttcaccagatgaatgcctagatacgggtatggattctggtaaaatacaaagaacatatttctactcctcgaataatgagcaacctaatagcatacttaccaataacctacagctctcctcaaaatcagtttttcttctcaatgttgtatgtgagaaacttatcagaatacttttggaagaatgcacaagcactgcttttcctgataaagggtctgtttcagaggaaacatcagcagaagaatgtcaacttttaaaaatgcttcaaagtgtagaagatggaaaatctgattatcgtaagggaggaatggactgtgaatgccttcaagtagattacatgtcagaccttttggagaatgtggcagaaattgatcaagacttattgacatcagactctatgcttactattatttcccacagcttggttaaatcattgatggacaaattatctcacagcatacaacaagctccggaaagtctaccttttgcaaataagcatttgaactacagaacaagagaaatacagtctagtttcataaaagcaagaaagtcagaattaatagaattaggacagagtaaaagttctttagaactcaggagctatgatagtaattctttgacagtatccctgaataatcccagtgtggttagctccaaaatacaagcaccatttaacaagcattgtgcagtaaaatcctcttctgtgtcaccttttgaaagacagagaacaaaggaaatggataaggtagccattcataataagctacatcaggaaggtatatatgctggtgtttattcagccacatttttggaaggaataatttcagaattgttttttaatctctctatgtcattgtggggcaaaaataaaaacatcactgtgtcctggctcaatgagatgaatacattatttgtcaacaatgtagtgaatgaatttaataatgctcaagtcactgttctacggaatgctgaagaaaggctgtgttttccaccagttcatacagaaactgttagcaaaattgttgactcagtttattatgatgttttacagcagtatgaattaaaagtggcctgtggtaataatccggtatacgacaatgcctcaatagcagaacaaataacaaatggcatattgttagagattttagactacaaactgccatcttgcttcaaggaacatctcataccccattcatattaccctctcaaacctgaaattatattgcaaaagcttcaaagtaacctaacagaatttacttctctacccaggtcttcatcagactatagtaccatgttatcacattcatttttagaagatgtcataagaaggcttttatctcagctaattcctccacccattacatgttcctctttaggaaaaaaatatttaatgagttctgattttaatgaaatgtccacttgtataataaataaggttatgtcagccatttcaaaacataaaatctggttcactatatatgataatcaatatctatatactggaaaaaacctccaaaagatggtggattctgtatattgtaatattttgcaaatgtctgactctcttgtttcaatacaaaaaagtatagtaagccgaagcccaattatgattgaccaaatagccagctttatcatccaagagattatcgaaaatcatcttcaaccatttttgagtggagaggttttatgtcatccaaggactccactggatccagtgtctactattgttacacaggttctgagtgaagtgatagagtcacacagacctcagaagcaatcacctttagatattcaccttgattcatttgtaagggagattgttgccagacttttgtcaaagattttcagcccaaagcataacactgaaattgagttgaaaaacatgacccaaagaatagtaaactccataaataggcatttcaataaagctaaaattcacattctctatgatgacaaagaacaggctttcttttctttcaatacagatattgtggatgaacttgccacctcagtttatagaaatgctttaaagcagcatgggctagaccttgctgttgataaagagtctgaagacagtggcatttttgtggaaaatattaccaatttaattgtagcagctatttcagattaccttcttcatccactgttttctggggatttttcagcttctacctattctaattcagtggctgagaatattgttcaggacatccttagtaacatcagtaaatctactgagccaagccagagtgtacctctatataacaccttgctgccatacacatttttagaagatatgatcagagtactattatctaaattattttcttctgcatctagcctggttctaaacagagacacccaaaaagatatatcaagagtgaatttcaatgacattgcttcaaacctagttagtgatattaggatgaaagtttcccaacatgaaattcgattttcaaaagaggaagaagaaaccaagtttatttattcagaagatgatattcagcaccttgttgattcagtatttgcaaatgttgtgcaaacctctggttctcaagaatcagctgtgcaaaatatcacaagcagtaatgacattcttatagatagaatagcaggtttcatcattaaacatatctgtcaaaaacatcttcagccatttgtgagtggaaaatcattatcttcatcagacacatattttgatgatgagagaaggcagttattttataccagtgtttactcttcaacattcttggaagatgtaatctctggggttttaagaaaaatattccacagggtagtaggcattgtacaaacaaaatccataagagattcagaagatgaactgtttgagaaagctgaagaactcatacatttgattacaggggaattctcaaaagcccaagttagcattatagataatactgaggaaagactgtgtttacctccagtggagagggatgtagtcaaaacaattgttgacatggtgtacagcaaagttttgcaagaatatgaaatggaagtcgtgcccaataaagattttctaaatgacacaaagacattggctgcaagaataactaatatcatcctggctgaaatttttgatttccaaattcatccagatcttatagcaaatctgccttttaaatcacattccaaactcagtgcaaatgttttaatacaaagagttcaatatgatataagtaaatcaagattccaaagacaagcttcaacaatgtataccactatgttatcacatagtcatttggaaaaaatagttactcagcttacatctcagataagtccattgaacaccagtgcagagcagtcagatactactaaatcagacttaagtaatacagtgataaaactgataaatgaaattatgtcaataatttcaaaacatgaaatatgtattattaaatatgggaataaaaaacagagtatgatttcagcaaaagatatccagtctatggttgattccatttatgctgatctttctcattcaaatatataccagtccattacaaaagataaaaagagcataagtgacatacctgtttcaaaaatagcgagttttataataaaagaaatctttaaccatcatattcaatcatttttatctgaagataaaactctccttttggcagcagttgatcaaacttataaattgaaagcaatagatcctaaacaaagagaattatcttttattgtgaactcatctgtctttttggaggaagtaatttctgagctcttatgcaaaattctttatgcattttcacataacatgttggttactgaaaatccagatagagtgaaactgaaacttaccaggattgttacaacattggtaaattcaattgttctggagttcaccacatcagagattttagttgcagataactttgataaaaatttgtgtttctcagaaagatacaaagaaatggttcaaaaaatagtcaactcagtatatggaaaagtattagatcaatataaatctctgattcaaatacatagggttatacaaagtgacacaatatgttttggtaggaaaatatattatttgctattggaagaaatatatgattatcaagtgcagtcattagtttcaggagaattagagtcttcttcttattcgtatccccaagctgataatatcatcagaaatgtgcttaacataatcacaaaggatagccatgccttgccaccatatattactgtgttgcctcattctcttttagaagatatggtttacaggcttctagggcatgtcttcccttcaactcacactgaaaatgaactaaaagagaaaaagtttccaccggatgatgaatttgtggaggcagcttcaaaattgactgatgaaattataaaagaaatttctgaacatgagattcgactttccatggcagaggataatgcagaaagtatgcagttagaacctattgaaaatttggtcgactccatatgtaataatattttgaaaacatctgaattccaagctgaagtacaaaaagatgcagacaaaaaaggatgctcattcctcagtaaattagctggttttattatgaaagaaatcatgtatcatcatttacagccatttttacatggtgaagaatcatctttcagtgacttatctgattatgaccatgtctctgaacttgctaaatctggtaaagaaaagacacagccttctctctattcagctacatttttggaagacataatcattgaccttgttcacaaattttgttctctcctcattattactgaagattctaagaaaaatgaaatggcagagctagatattatgggcttggctctaaaacttgcaaattctctgataagggaatttaagaaaagtgatattaaagttttaccaaatgctgaaaaaatgttttcttttccaccaattgataaagagacagttgataaaatatccaattttgtatatgaacagttcatagaaaaatgcacatctcatgatattcaaaaaggtgatgaaagtaacattgctatagggatgattgctgctctaacccagaaggcaatatctgcattcaggattcaaccacttttttcaggagactggtcttccaccttcttttcatttctaaatccagataatatcacccaaagggttcaacacctaccacaaaacacctttacacaaataagcagatgtgcaaaagagaaccaactttctttaccagatcaatcatataaagatacttcttccaccccagattgcaaaaacatgatgagcactttggaaataaatagaggtacaatgaatagaaagaaaagttttaaaaccaaggacacatcagtgaaaaaaggtgacatccaaaatccagtacttagctctataaatgcaattatgaaaagcggcatgattaacctaacatcagggttggctacaggtgtgacaaataaaaaggaagtggatgaaaataaagtgggaatttgtactcaaaaacatagtgagaatgtatcaaaagttacttcaactaccactgtgaaaagtaaagatactcaggagccaaatttgagtgaaacatttaataataatgaaattgagaagaaaagaaatttaattccaacagataaaaaagggaaagatgatgagatatacacacatttttcattaataattgatgatacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacgagaagtggctagcaatcagctgcagagctatttttgtggagagctaactccacatcagtgtgtggaagttgaaaacatcgttgaaaagatccttaaagatgttttccaaactactgatgtgcccctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattagatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcata

SEQ ID NO: 134513 - DNA, 3882 bp, Homo sapiens
  Payload ID: 6281
  Gene Symbol: FSIP2
  Gene Name: fibrous sheath interacting protein 2
  ENST ID: ENST00000611759
  CDS Start-End: 605-2545
tacagaatatgagaaggaagtacttggatcagattctgaaataggctataaaaagaagattgacaatgcaagggaaagctcatttaaaaaagatgacaagctctttcagttatcctccttgaagtccaagagaaatctagggactacaacagatactttggaaataagaattcgaacatcaagcaatgaggggagaagagactctccaacacaaacgtgtagggatgaggaacaccactcagattatgaacatgttcaaaatgtcattgaaaatatttttgaagatgttttagaactatcttcttctccagaaccagcatattattcgaaactcagttatgaccaaagccccccaggtgataatgtattaaatgtaattcaagagattagcagggattcggcacagtctgttacaacaaaaaaagtatcctcctcaactaacaaaaatatctctgccaaagaaaaagaagaggaagagagagaaaaagagaaagtaagagaggagattaaaagtgaacccagtaaaccagatgatcctcaaaaccaacgagaaagtaaacctggaatttttcccgctaagtttttagaagatgttattactgagatggttaaacaattgatcttttcttctataccagaaacacaaatacaagatagatgtcaaaatgttagtgataagcaaaatcaagccaaactctatgacactgctatgaaactcatcaattcactgttaaaggagttctcagatgctcaaattaaggttttcaggccagataagggaaatcagttccctgggggtaaagtgtcttcagttcctaaagtacctccaaggtataaagagccaactacagatgaagcaccatccagcattaagataaaatctgcagataaaatgccacctatgcataaaatgatgagaaaaccttcttcagataagataccatcaattgacaaaacattggtcaataaagttgttcactcctctgtttgtaatattttaaatgactatggatctcaagactctatttggaagaatataaacagtaatggagaaaatttagcaagaagactaactagtgcagtgataaatgaaattttccaacgtcaggttaacttgatattttgtgatgaggtttcagtttcagcatgtttgcctctggaatctaaggatgttgttaaaaaggtccaaaagttggcccaaacagccagcaaagaatgtcaaacttcatcaccatatacaataatattacctcataaatttttggagaatgtgatttctgctcttttctccaaaattttctcaacaatatccagcacaaaaacaaaagaacctgaggacaatttgtccacagaactgaatttccttcaaatgaagttagtaagtgcagttgcaacagagatctcccaagataaatatatgactatacagtatgtagaaaccttacaatctgatgatgatgaaattattcaattagtggttcagtctgtttataataatctcttgccacagtttggatcacaagagattatacaaaattgtgtaaccagtggatgcaaaatcctttcagaaaacatagttgacttggttctacctaaaccttcacatgctgataagctgtcttataacataatagaagaaattgctgtgaaatttttatcaaagcttttatctatatttccaaaagtacataaagaaagaacaaaatctctagagactgatatgcaaaaaataacttcaaaagtactaaattcagtccaagaatttatctccaaaagtaagattaaacttgtaccacccaccaaggaatcacctactgtgcctgtagctgataatgcaactattgaaaacatagttaattctatttataccagtgttttaaagcactctggctcttatacttctgtatttaaagatttaatgggtaaaagcaatgtcctctctgatacaataggctttttaatggtgaatgcaatttcgaattctgaatttcaacctcaagtagaggaagaagtatcaaattcagaattagttctggaagctgtcaaaattatggaaaaagtgatcaaaattattgatgaacttaagtctaaggaaaagtcttcatccagaaaaggtttgacattagatgccaaacttttagaagaggtgttggccttgttcttggctaaactaataaggttgccaagttcctcaagcaaagatgaaaaaaacttatcaaagactgagttaaataaaattgcatctcaactgtcaaaattggtaacagctgaaatttccagaagtagcattagtctaatagcttctgatcctgaagagcactgtttaaatccagaaaatacagaaaggatttatcaggttgtcgattccgtttatagtaacatactgcaacaatcaggaaccaacaaagaattttattatgatataaaagatacaaatacagcctttcctaaaaaagtggctagtttaattattgatggagtttcaagttttccattaatacaattaactcaacaatttcaaatgctgatctctctggagagctagacgttaatagaattgttcaaaaggcccaagaacatgcttttaatgtgattcctgaattagagcaagaaaagttagatcaaaatttatctgaagaggaatctccaattaaaatagttccacatgttggaaaaaaaccagtcaaaatagatccaaaaattatttcagaacacttagcagttatttctataaaaactcaacctcttgagaaacttaagcaggagtgtttgaaaagaactggacatagcatagcagaactgagaagagcatcaataagtgggagaaattactccttaggatcacctgatttagaaaagagaaagacagaaagacgtacctcattggataagactggaagactggatgtaaaacccctagaggccgttgctagaaattcatttcagaatataagaaagcctgatattacaaaggtggagctcttaaaagatgttcaaagtaaaaatgatcttattgttcgattagtagctcatgatattgatcaagtgtatttggaaaattacataaaagaggaacgagattctgatgaagatgaagttgttttaacacagacttttgcaaaagaagaaggcatcaaagtatttgaagatcaagtgaaagaagtcaagaagccaatacaaagcaaactttctcctaagtcaacactaagcacgagcagcctgaaaaaatttttgtcactaagtaaatgttgtcagaccacagccagtgcaaatattgaaagtactgaagcaatctcaaatcaggtaatagaatccaaggagacacatgttaaaagagctgttgctgagcttgacatggccacaccaaagacgatgcctgaaacagcctcttcatcttgggaggaaaagccccagtgtaagaaagaagaaaagaatcttgttactgaaccaacacattacttcatacacagaattatgagttcatcttcatacaaccaagaagatctcatttcatctactggtgaggctgaagattgtcactcagacccaagtgctaaaatattagaagaaagttctcaggaacaaaagccagagcatggaaacagtgttaagtttatcaccatctttgaaagatccaaggatgttcttggcagtgcaaatccctcaaaggaagtcatttcagaaactcccaagcccgatgtctccaaacaaggatctaaaatgctgacaaaaatgtcttcaactttgtcaaaggtgttttctcaatgtaacaccaatatttccagatcttcctcaccagctcaccaggatgaacactgaagcttttgtacctgatataagtatgcttacttcttttagaaaataaaatggtttttaaagcat

SEQ ID NO: 134514 - DNA, 2251 bp, Homo sapiens
  Payload ID: 6282
  Gene Symbol: FBLN1
  Gene Name: fibulin 1
  Uniprot ID: P23142
  ENST ID: ENST00000262722
  CDS Start-End: 104-2155
gttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 134515 - DNA, 2896 bp, Homo sapiens
  Payload ID: 6282
  Gene Symbol: FBLN1
  Gene Name: fibulin 1
  Uniprot ID: P23142
  ENST ID: ENST00000327858
  CDS Start-End: 96-2207
ccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctga

SEQ ID NO: 134516 - DNA, 2348 bp, Homo sapiens
  Payload ID: 6282
  Gene Symbol: FBLN1
  Gene Name: fibulin 1
  Uniprot ID: P23142
  ENST ID: ENST00000340923
  CDS Start-End: 11-1711
cccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggccc

SEQ ID NO: 134517 - DNA, 2355 bp, Homo sapiens
  Payload ID: 6282
  Gene Symbol: FBLN1
  Gene Name: fibulin 1
  ENST ID: ENST00000402984
  CDS Start-End: 104-2269
gttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcagagccgtggggttggcctcactgtgccaggacctgaatggggcgtgggcagtatggaaagtgggaagagcatcccaggccgagggaacagccagcgcaagagcccagaggagagggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcc

SEQ ID NO: 134518 - DNA, 2531 bp, Homo sapiens
  Payload ID: 6282
  Gene Symbol: FBLN1
  Gene Name: fibulin 1
  Uniprot ID: P23142
  ENST ID: ENST00000442170
  CDS Start-End: 17-1822
ccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgcacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatgg

SEQ ID NO: 134519 - DNA, 572 bp, Homo sapiens
  Payload ID: 6282
  Gene Symbol: FBLN1
  Gene Name: fibulin 1
  ENST ID: ENST00000439835
  CDS Start-End: 1-279
gcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtcagcgccgaggcctcggcgacgcccccctcccccacggccagctccggtcctcatctcctccccggcctggggacttgtttcaaaaccggattcccccacccctcaaacacaccgtcctaccccagtcctagcaaatccagccggctccgggggccgcatcccgggccctgggggttcaggggcgctagctgggctgggggacgctggctgggggttaccgagcccagggcgccttgcacttgacgctggaagcgccctcggctatctttcctcaccgcttcccgcctccacccccagtggacgcggatgtcctcctggaggcctgctgtgcggacggacaccggatggccactcatcagaaggactgctcgctgccatatgctacggaatccaaagaatgcaggatggtgcaggagcagtgctg

SEQ ID NO: 134520 - DNA, 753 bp, Homo sapiens
  Payload ID: 6282
  Gene Symbol: FBLN1
  Gene Name: fibulin 1
  ENST ID: ENST00000437711
  CDS Start-End: 1-550
gaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaact

SEQ ID NO: 134521 - DNA, 671 bp, Homo sapiens
  Payload ID: 6282
  Gene Symbol: FBLN1
  Gene Name: fibulin 1
  ENST ID: ENST00000455233
  CDS Start-End: 155-671
ccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggaggcgggccctgcaagcagcagtgccgagaca

SEQ ID NO: 134522 - DNA, 512 bp, Homo sapiens
  Payload ID: 6282
  Gene Symbol: FBLN1
  Gene Name: fibulin 1
  ENST ID: ENST00000445110
  CDS Start-End: 318-512
aaagctgcctcccctgcagcctcggtgacttcccgggtctctccctccggccctggtgtcccgggtgagcccagcacacgttgggattttggttgtttgttggcctggcccgactgtccctgtctctgagggcagagtcgggtcccatcccgggacacgcctggggttagccaccgacctgcagcctcccggccgagggtgcggggttggcgtcctgtcctcaccagacttctcacaggtccccgtttctgtggaagaggggatcttgtgtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaag

SEQ ID NO: 134523 - DNA, 565 bp, Homo sapiens
  Payload ID: 6282
  Gene Symbol: FBLN1
  Gene Name: fibulin 1
  ENST ID: ENST00000454279
  CDS Start-End: 148-565
tcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgag

SEQ ID NO: 134524 - DNA, 544 bp, Homo sapiens
  Payload ID: 6282
  Gene Symbol: FBLN1
  Gene Name: fibulin 1
  ENST ID: ENST00000451475
  CDS Start-End: 1-544
tgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaag

SEQ ID NO: 134525 - DNA, 568 bp, Homo sapiens
  Payload ID: 6282
  Gene Symbol: FBLN1
  Gene Name: fibulin 1
  ENST ID: ENST00000411478
  CDS Start-End: 1-568
atgaattcctatacaagaggctcccgcaggcccagcgccaaagctgcctcccctgcagcctcggtgacttcccgggtctctccctccggccctggtgtcccggtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgag

SEQ ID NO: 134526 - DNA, 599 bp, Homo sapiens
  Payload ID: 6282
  Gene Symbol: FBLN1
  Gene Name: fibulin 1
  ENST ID: ENST00000460300
  CDS Start-End: 1-183
gacatcacggaagggaacctgcgggactcttttgacatcatcaagcgttacatggacggcatgaccgtggcccctctcctgaactgtcacattttaaaagatttacagtcatgggaaatgaaaacggtggcatctgccattttggactcggatttatactctgaacactttcaaagcagctgagcaacggacggacagtccctgacctcccctgggcctcagtttccccattgtgaactgggaggagtgggcttcctagtcccttaggcgctggagtccgggaggtcctaaccagaacccacgagcgtgcagtgcgcacagagcagagcgttttggagcctggcctccaggtggcgctgttggaccttggacgctcagtctttgcgcctcaaacccgacggttgttaaaactggcagctggagaaagggaatcgttattcccgtcttgccaaagagccatttatagcacctttacaagcttttaaatgggtttgcatgttgtaaacatgactgagtcactggggggctccccaccccagcctcctcctgcgctagctggcagcaggaataattagttaattacaattaatggtgcatta

SEQ ID NO: 134527 - DNA, 4127 bp, Homo sapiens
  Payload ID: 6283
  Gene Symbol: FBLN2
  Gene Name: fibulin 2
  Uniprot ID: P98095
  ENST ID: ENST00000295760
  CDS Start-End: 70-3624
ggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 134528 - DNA, 537 bp, Homo sapiens
  Payload ID: 6283
  Gene Symbol: FBLN2
  Gene Name: fibulin 2
  ENST ID: ENST00000295761
  CDS Start-End: 1-329
acatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaa

SEQ ID NO: 134529 - DNA, 4318 bp, Homo sapiens
  Payload ID: 6283
  Gene Symbol: FBLN2
  Gene Name: fibulin 2
  Uniprot ID: P98095
  ENST ID: ENST00000404922
  CDS Start-End: 120-3815
agccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtcccttta

SEQ ID NO: 134530 - DNA, 427 bp, Homo sapiens
  Payload ID: 6283
  Gene Symbol: FBLN2
  Gene Name: fibulin 2
  ENST ID: ENST00000421373
  CDS Start-End: 1-305
acgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgc

SEQ ID NO: 134531 - DNA, 4193 bp, Homo sapiens
  Payload ID: 6283
  Gene Symbol: FBLN2
  Gene Name: fibulin 2
  Uniprot ID: P98095
  ENST ID: ENST00000492059
  CDS Start-End: 383-4078
gattcccttcatttatttcatcatggggctcatgcctgcctggcgttcagttctctacagatttgctcttgggtttattatctgcccctccacccctgagggtgtcagtgctgtgaggacgctgggaacctgtcttgctggctgataaacccctggttcctagaggggctgggtgcagaggaggcgttcctttagaaatggggcaggcttggggaccactgctgtggtaacgagtcctgctgtccctctgtcactgccctatggggctgcgctttaggctgggagtcggagaaggagctcttgcctgtgactttggggagcacgctgtctataagagtcagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgc

SEQ ID NO: 134532 - DNA, 584 bp, Homo sapiens
  Payload ID: 6283
  Gene Symbol: FBLN2
  Gene Name: fibulin 2
  ENST ID: ENST00000465610
  CDS Start-End: 109-584
acacatacacgccccattgggagcagctgtggagatgtgaggacagtgaggtctgctattctcccagggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggc

SEQ ID NO: 134533 - DNA, 2423 bp, Homo sapiens
  Payload ID: 6284
  Gene Symbol: FBLN5
  Gene Name: fibulin 5
  ENST ID: ENST00000267620
  CDS Start-End: 171-1640
ggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatggagtttccctctcgtcgcctaggctggagtgcaatggcgcaatctcagctcactgcaacctctgcctcccgggttcaagcgattcttctgcctcagcctcccaagtagctggaattacagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagag

SEQ ID NO: 134534 - DNA, 2123 bp, Homo sapiens
  Payload ID: 6284
  Gene Symbol: FBLN5
  Gene Name: fibulin 5
  Uniprot ID: Q9UBX5
  ENST ID: ENST00000342058
  CDS Start-End: 595-1941
gccacgcagcgcgggcgtgcacgcccctccccgccgggccgcgctgccagccccgccccgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcag

SEQ ID NO: 134535 - DNA, 730 bp, Homo sapiens
  Payload ID: 6284
  Gene Symbol: FBLN5
  Gene Name: fibulin 5
  ENST ID: ENST00000557570
  CDS Start-End: 463-570
ttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacagcaacaggagagatggacccctgtgtgtcagccctgaaatgtgggcagatccctcctgaaaactccgagtggcctctctgtgtctctggctcaggaaagaagtgagagaagccctatctctgagcaggctgagggctgcaggcaggcacagtgcacgaatggctttgacctggatcgccagtcaggacagtgtttag

SEQ ID NO: 134536 - DNA, 900 bp, Homo sapiens
  Payload ID: 6284
  Gene Symbol: FBLN5
  Gene Name: fibulin 5
  ENST ID: ENST00000557088
  CDS Start-End: 356-490
agttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagcatctctctgaccaatcagcctcttcttcttctacttttaagaactcctgtgaatatatcgggcccacccagaaaatccaggataacctccccatctcaagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaa

SEQ ID NO: 134537 - DNA, 547 bp, Homo sapiens
  Payload ID: 6284
  Gene Symbol: FBLN5
  Gene Name: fibulin 5
  ENST ID: ENST00000554468
  CDS Start-End: 275-547
ccttcttcgggaagatcgcgactctcccgtcgctcgccccaagcctctgcttcagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccg

SEQ ID NO: 134538 - DNA, 1875 bp, Homo sapiens
  Payload ID: 6284
  Gene Symbol: FBLN5
  Gene Name: fibulin 5
  ENST ID: ENST00000556154
  CDS Start-End: 333-1694
attgttaattataaaaagctgcgcctctgtaatttccatcttgaagcgttcttttgggagtgggtattttctaatacagtttcaaaagccagcatcagagagggctgcgaaattctcagcgcttcattcctctttcttttctggaaagggcagcaactttgtcgttttaagggatttttgtatgtattttttaaatttcgggaggccaattactagttcactagcaattactgcgccgcatcggctgatagacaagcagacaggctagctgaacaccgcggggctggatttgctctatgtttgtgtgggattctcacagaagtttcaagccaatgagaagtgggaactgcagacagagatacatgatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgca

SEQ ID NO: 134539 - DNA, 1479 bp, Homo sapiens
  Payload ID: 6285
  Gene Symbol: FBLN7
  Gene Name: fibulin 7
  ENST ID: ENST00000272559
  CDS Start-End: 1-786
gcgggctccgccaggacactggggacagcacggggaggacatggggcggggaaggggctctcacccaccgccctcctgccggcacgggtggcttcctgcgcgcggtctcagaaggcctggccactttgcattatagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaa

SEQ ID NO: 134540 - DNA, 2301 bp, Homo sapiens
  Payload ID: 6285
  Gene Symbol: FBLN7
  Gene Name: fibulin 7
  Uniprot ID: Q53RD9
  ENST ID: ENST00000331203
  CDS Start-End: 272-1591
cttagcccaggggccggcgcctccccgcctcgcgcggactgtctcgtgcgggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcctg

SEQ ID NO: 134541 - DNA, 1989 bp, Homo sapiens
  Payload ID: 6285
  Gene Symbol: FBLN7
  Gene Name: fibulin 7
  ENST ID: ENST00000409903
  CDS Start-End: 231-1331
tctcgtgcgggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaa

SEQ ID NO: 134542 - DNA, 1124 bp, Homo sapiens
  Payload ID: 6285
  Gene Symbol: FBLN7
  Gene Name: fibulin 7
  Uniprot ID: Q53RD9
  ENST ID: ENST00000409667
  CDS Start-End: 74-991
catcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagagatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggc

SEQ ID NO: 134543 - DNA, 1394 bp, Homo sapiens
  Payload ID: 6285
  Gene Symbol: FBLN7
  Gene Name: fibulin 7
  Uniprot ID: Q53RD9
  ENST ID: ENST00000409450
  CDS Start-End: 74-1255
catcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcgtt

SEQ ID NO: 134544 - DNA, 819 bp, Homo sapiens
  Payload ID: 6285
  Gene Symbol: FBLN7
  Gene Name: fibulin 7
  ENST ID: ENST00000441565
  CDS Start-End: 1-819
cgcttcgccgagggcatccgccacatgaagagccggctggccgcgctgcagaactctgtgggcagggtgggcccagatgcccttccaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaac

SEQ ID NO: 134545 - DNA, 1816 bp, Homo sapiens
  Payload ID: 6286
  Gene Symbol: FICD
  Gene Name: FIC domain containing
  ENST ID: ENST00000361549
  CDS Start-End: 105-647
gctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagaaagcaggaggctaggaagccaaggaggtgcctcccagaatacaagagagtggctctggggacacacggatagtgactgcataccaccacacggctggggcaacagagtggtaccgggcatgttgagtacacacgatgcggctgcaacaagctcctcaaggccagggacacaggctggtcatcatggtttcctgcggagaccagcacaggggacagccccccgaatgtcctctgccccctagcctccctccctcacagcgcttctttggctctcttccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaa

SEQ ID NO: 134546 - DNA, 3347 bp, Homo sapiens
  Payload ID: 6286
  Gene Symbol: FICD
  Gene Name: FIC domain containing
  Uniprot ID: Q9BVA6
  ENST ID: ENST00000552695
  CDS Start-End: 236-1612
aaatgcgagggaaggacaagtggggaaagccaatccgccgcgacgagggctgcgggcggttcaatggcaagtcgccgggggcggggccagaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaa

SEQ ID NO: 134547 - DNA, 603 bp, Homo sapiens
  Payload ID: 6286
  Gene Symbol: FICD
  Gene Name: FIC domain containing
  ENST ID: ENST00000552758
  CDS Start-End: 121-540
gagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccaggtaagacagactggccgtcttcctcaatgcttgttaactggatagacagacatagaatgtgtcatgtcctgtatgtggggcatcggggtattgtgaacaagtcagccctgagctcctagtatagacaaggtgatgtgactgagacagtgtcacaagtgtggtgatggggaagcataaagggc

SEQ ID NO: 134548 - DNA, 397 bp, Homo sapiens
  Payload ID: 6286
  Gene Symbol: FICD
  Gene Name: FIC domain containing
  ENST ID: ENST00000549641
  CDS Start-End: 1-170
agtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagggaagtgctgtacctgaacacctataggaagaaggaagacagagaaaaaccatgattcgaggcatgacccagctcacctgactcctctgacaccagccttgtccccatgagcagcccagccaggcagactagagccaagccatgctctgaaacttgttaatggggccaccggagcgagtcacttaacctctccaggcctccatgtcttcctctgtaaaacggcaagaataaaagtaaccattca

SEQ ID NO: 134549 - DNA, 943 bp, Homo sapiens
  Payload ID: 6287
  Gene Symbol: FCN2
  Gene Name: ficolin (collagen/fibrinogen domain containing lectin) 2
  Uniprot ID: Q15485
  ENST ID: ENST00000350339
  CDS Start-End: 11-838
accagaagagatggagctggacagagctgtgggggtcctgggcgctgccaccctgctgctctctttcctgggcatggcctgggctctccaggcggcagacacctgtccaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 134550 - DNA, 1057 bp, Homo sapiens
  Payload ID: 6287
  Gene Symbol: FCN2
  Gene Name: ficolin (collagen/fibrinogen domain containing lectin) 2
  Uniprot ID: Q15485
  ENST ID: ENST00000291744
  CDS Start-End: 11-952
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctgggcccaagggagaggcaggcaccaatggaaagagaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 134551 - DNA, 1286 bp, Homo sapiens
  Payload ID: 6288
  Gene Symbol: FCN1
  Gene Name: ficolin (collagen/fibrinogen domain containing) 1
  Uniprot ID: O00602
  ENST ID: ENST00000371806
  CDS Start-End: 93-1073
cagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaatgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaag

SEQ ID NO: 134552 - DNA, 4369 bp, Homo sapiens
  Payload ID: 6288
  Gene Symbol: FCN1
  Gene Name: ficolin (collagen/fibrinogen domain containing) 1
  ENST ID: ENST00000616356
  CDS Start-End: 7-1089
gagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagccagacacactcccatgacgcccacagctgcccctttgcccccagctcagtcaagccgccacatgcccacaacctcaccagagggagaattatgtttctaaatatgtttactttgggacagaaaagttttaccagtttcaatgtgtgtttcttgaacaccagtggttttgatcactttcctgtgtctgttgcacggcaggtctttccctggaatttggtaagtcgggaagagtcaggacccttatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaacgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctggggttctggcaatgctctgtttcttgacccaggtggtgattgtaaggatgtttgttaactagtgatgaaaataattaagctgtacttttgctttatacacttttgagtacatgttatgttccacaatttaaaaactacttataaagaaactgcacatgcttggatccaggaacatgagctacaggcacatcctccactgatgcccagtgttcttgactcaatacctgtaaggagaggtccttgtagcccattgggggctgaccagaccctactacgcccctgccacaatctctagtccatcacaaaatccactattgggatagtactttcgtccctcagtaggtaagcatttttacaacctaggaagacttagctttaagtctagaaatgattagtataaatataaaatataaatatgattaatataaatataaaatagccatagaaatatgccttttagtttgttttttgagacagagttttactctgccacccaggctggagtgcagtggcgtgatctcagctcactgcaatctccacctcccaggttcaagagattctcatgcttcagcctcccaagtagctgggatcacaggcacacacaaccatgcccagcaatttttttgtatttttagtagagatggggtttcgccgtgttggccaggctggtcttgaactcccgacctcaagtgatccacccgcctctgcctcccaaattgctgagattacaggcgtgagacactgtgcctggccaaaatatgccttttgtattaaggaatctggacaggtttgatttttcacagtcttgtaatgtttaaataatttggcctattatgaagaatctcacaaatccaatataaaatgtggaactaactaatcaaaatcatcttgtaatattacatggaaatcttagtgcgtttatacacggtattggcatatttaagagactttgagctcattgcatttctaagttaaattattagatttcttaagatttaagttaaattattagatttttaaagattaattagtgctaaggagggttttctcattagacagctgaaatgccgcaggagaaatttgagtgtattccacttcttattgcaattttaaatgtttgaagttatttaaagaactaaatttatggtatccaaaagctctaaaaaggtgactcttaagatttgcaggtcttataaatagaaaaacaagaactgtaagccaaacttaaaatattcaggatgaattgagtttttgaatttgtagctttcagaaactgaacattaattttaagaagcaaagcaggctgggcacagtggctcacgcctgtaatcctagcactttaggaggctgaagtgggtggatcacttgagatcaggagttcaagaccagcctggccaacatgatgaaacctcctctctactaaaaatacaaaactccgccagaaatcgcttgatcccgggaggtggaggttgcagtgagctgagatcgtgccactgcactccagcctggggaacagagcgagattccgcctcaaaaaaaaaataaaaataaaaagaagaagaagaagaaggagaaagagggagagggagagggagagggagagggagagggagagggagaagaagaagaagaagaagaagaagaagaagaag

SEQ ID NO: 134553 - DNA, 1030 bp, Homo sapiens
  Payload ID: 6289
  Gene Symbol: FCN3
  Gene Name: ficolin (collagen/fibrinogen domain containing) 3
  Uniprot ID: O75636
  ENST ID: ENST00000270879
  CDS Start-End: 7-906
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttc

SEQ ID NO: 134554 - DNA, 997 bp, Homo sapiens
  Payload ID: 6289
  Gene Symbol: FCN3
  Gene Name: ficolin (collagen/fibrinogen domain containing) 3
  Uniprot ID: O75636
  ENST ID: ENST00000354982
  CDS Start-End: 7-873
agcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttc

SEQ ID NO: 134555 - DNA, 9536 bp, Homo sapiens
  Payload ID: 6290
  Gene Symbol: FIGN
  Gene Name: fidgetin
  Uniprot ID: Q5HY92
  ENST ID: ENST00000333129
  CDS Start-End: 316-2595
ttttgggtttgaaattccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatggcttgaagatgcagtggacgccagagcatgcccagtggccagaacagcactttgacatcacctcaaccactcggtctcctgcccacaaagttgaagcctacagaggtcatctgcagcgcacctatcagtacgcctgggcgaatgatgacatatctgctctgactgcatccaacctactaaaaaaatatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttagaaaaaaaaaatgtaatgaatgttggcacacacacataaaacctgctacatagggaatagagcccctttccagtagagtttaaattgcaaagggtactggggaagatgacgattaagttgcatctttagagtcagggtagatttggaggaaaagtgcatcaaatgagagcttctgatttgaaagccccagatgacagaaagcatatgtggatgctcagttctgttcaagctagacaacactcaccaaggagcaaggtgcaagtgtgttgatttcagaaggacatgaacctcgtgtgttgattccattctgctgttctcgagatttagttgctgtcaagtgcctggagtggtgctttattttttgtttgcctcacaattacattggtggcatgtgctaatataaagagctttaacttcaaacattattggactaaagagatgaacagttgtgttatgacagaaaaccagatttttgccattttaagagcaacagtattcctcaatcctgtctgttctgcagtattaagctaagaacaggtaaaacagggtaacggtaatctggaccttaatttctgcagttcatttcttttaatgttcttgtctgcaaaaactcaggaaagtgattgtgatttgtacagtacctcaaaggaatgtgttgaaagcactatgtactgctgagagtaataggataggcttcaatgttactttatattaaaatgtatgtttacctcaacaattggaaaatagcaaggaaaattactttgaatgtatccagaaaaatactgaagtgtgatacaactgaatatttacagtttaaagtagaaatggaaggatttttttaagttcttttactaattatggggaattaaccagagcagaataattctttatgtcaataactgcaagagttcttagtacattgctccttgataattaagtgaaaatgttcttaaaaggtacactggttaattgaaagctacttattcagtttgtgttagtgtctagacctgtcagccacaagacctgtttaggaccctgaaagtcacagtacctaaaaactatgactgcctttttattgcataggtggtagtggtggtgatggtggtggtagtttgcaagttatctcttaaaactgctgggaatggtgtcattctattcactaatctagcttatagacttgccgtgctgtttgatagaatgcagaggatagcaaccaaaacaaatacacaaataaataaaaacaaaaaccaaccaacaaaccaacttacatacacatatatatatccacaaagaacctctccatctcctccccttctttttgactccactcttgtcagtgcaattttgcttctcattttgaaatctgggctgtagtgctcctgctttatttctacctcagttttgttacatttctcttggaaagtaaagtagaaaattggaagtggacacacacactgcaatgtagcttgccaaacatgttactttgttttcttccatctttcaccgtaaatctagtttccaaagacatcagcatttgtgcttacttccacctcagtctaccagccccacccctacccatggcataagtggcatttttcttaatttcctatttttctcctgctctctgtcaagttgttctttgtatcctttaatgctttatgtgcaacctttcattgatagtgggctgatgtttggcaatgcttctgaactgtcacagagcaggctgtagctttccacagccactgcccatgcataagcagaacagcctggccttttgaatgtattttcctgggttttttccccttttctttttttagtttagagatgcagtaacaaaactgttgcaaagcactggcattttatgtattcaataaataagtgatgtacatttttaaaaaaatttaaataaatgcaatgagaagccccaagaaaggcctttctgttttttttttcttacaaaaatttttaccgatcttatccacaatatccaattctctgaaacacttaacatagagaaagctcatgagggatttcttatctctgaaattttatgatgcttgatctttactcccctttttttattttttatgttgctaaaaactgagcaattgaaccagaatttaatttactgtgacattctgtcaattaaagctgtgcttaaatataaatattccatattaaaaagcagtgcctttcattaaggatacaaaaaataatacttaaatacgccctctgcttttcgcaagtgaataaatgctacaatcgtgttctgggtctaccctgtgcatcccttgtaaggaaattctaatatccacattaacttgtaggttcatattgatctcactgacaagtttacttttgcacagtgctgacctattttctgacttttagacattatatttcatttccgccaacatgctgtgttcacttgaaagcgtctggcaagttttgacaaacccagtcttatttagacaactttggaaaatccaatattgacccacatttttttgtggctagtaagatttaatgccaaatatatgactgcactattgtgttttacactcatttataaaactgaaaataaattgaagtcatacatcttggcttttagctttaagtgacttaaaaattagaactctgagtgacttaaaaattaatttgagatgcaagtggtcaaaaatccatgtatttagacagaagctgaagtcgtatgtgattttcatttagcctcacaaaatccaagatttgatctcttaggaaattgggcatgttgaagaaatgaagatctgttggaggagatatggctgacctttgagtagatagtgctctcctgtgattctttgattctgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaaaaggaagtgaaggaaaccacttcagtattgggatcaatagaaattcaagaggtagttcataatgaccttatatgtgacacaaatggaaatactctacacttctggcatgcttctctcccaaatatttagaacattagtgacaatatgaaaaactttgctgactgagctgatcaatggaatgtgaaggcagtatactttaaggctatttactttcacacagaatgtttatctattagtcagtttgtattctactcaaatgcagatagacgggtataatgttttcttgtgcatttgaaacctatcaaggagaaaataaaccattccactaaaatacataggccaaacaccatctgggaaagtgataaaagctatccagaggctatgctatgtaaaatagcaaggtcaatttacatgggttgcatagtacttggctatgcagttttcaaaagaacacatccaaaaaaaaaaaaaatccaaattagttcctataataggtctttgtaaatttaaatatatttgtgggttggaaaatacgtttttagagacatttagaatttctttctctaaaaatgtatccaactccaagcagaaagagacttctgtactcacattctcatgtttcttagaattgggtagcatgatcattgaatctgtattttgcaaagtgaaagggacgcagcttgttgaactattgaggccactaaagtaaagttctaatatatatatataaatataaaattagtgtgtgtgtttgtatgtgtgtatgtgtgtgtgttctttcatcaccacctagttgaactttaaaacagacgtctacttttcattattcagaagcaacttgttacttcctttcttcatatgtgcagagatacacatgatcatgttacaatttgaagtgttttaatgtgtttttttttcttttgaaacgtaaagccttcagttgttgaatcatctgccgatttttatatgaagcacattagcaaacctggagctattagtatttcagaattcacaaccagctgtacttgtgactaaccaacacatgaactgaagctcacactttgctaagacctttggttgacattcgattttgaacctgccagatgcatttgtgtgaaccagggatactgcatctttaatgaacaagtctctcctctttcccctgtttttaaatacaacacaagcagtgtagcactaggcactgcaattgtcaaagacaattagactggaagcaggaaaatttcacctccctgtctcagtgatatgtagaatgtcggcagcatgggtcagccttgccacagagttgtgtgagaatatatgaatcagtcctatagaatgttaaatatttataaaatggttctgtagtacaccaaggttgggagcacattcattccttcttgttgtcttatgatacaaaaaaaaaaaaaaaaaaagcaaaagtttatttctgggcttaaaactctccctctaatatctctctctcttttacccccattccccaaccattcttctctccatccctctcctctcctcttcctctctcttctctctctctctctctctctctgtctctaactctcgctctctcttgtatgtgggtgtgtgtgtgtatgagtttccactgtggattatatacacttgctagagaatattcatttcttttttttcttttttcatctgatgtatattcaaacattgttctttataaccatttctacctcattgctacatattgtacatgtagtatttatttgttgtctttttttgaatgtcatgcatttcgtaagaaaaagacttgtccttgaacttgaacagtctacctcagaaagactgtctttacactgaacagtattagcaacctaaatgataagacgcattagtgaagtgtggcagggtagataatgcacgagtacttgggatactgatggacttttaattgtattcataacacaagactgcttaaaagaacttaaaagaaattatgcactgtgtaggtcttcatcgaggtcccatttgggacattatatacagaatagagctttattcctatgtgcccatctctgagaaatgtgttagcattcccaagtattttacactggcaatctggctacttaagacaaacaaattcaaacaacatttttatattttgactgacaccctcagctcctaaatttaagagaaataatggtacttaactattttcaactatagtcttcagtgattgaaaatgccttcattttaattctgtgactcctgatataaattaagaaaaacaatgcagttgcaagggcctgcacaacactgaaaataaaccaaaaattaaaaatggcacttcccaaaggaattaacaaacgtggagtcatggtgcttgcaagttccataactgaaagcattttgtttctgatttccctttataacatgtatttgtttattgaagcaattgtacaactaatggcacattgaattactttgtatgaagtgttttatattatactatttattttagcattcgttctttttcttcaccagctctatattacagtagcaaaagaacacttagttttaaaaaatgctgaaaggggttcaccacccacccaatcgatgaatggacttttgaagttgcttgtcagcaaattgtggatattttacaaaagcaaatgaactgtgacaatccacaactcccacagatgtgaattcagaaatgcatctgaaactccggtatgcctgacaatctattctttaagtttcattaacaaagtggcatccaatcctttcacttacaattccttgcaggaatgtattgtctagaggctgtctagtagtgattaagagagggtttttgttttgttttatttgtttactgtattaggtgaggaatgccatatttcttgtcagccaacagtacttgtctgagacagaaatttaaaaaaagaaaaagaaacctaactaattaaaatttctgtgcactttgcttccctgaccatattgattttatttgcttaaattgaaacaatacgctggatttgaccagattttgaccccttgaaagaagaaaagccctatatagtacatgtttctttgggttattctagtactgtttccttatttgttctgcaaatttcaaatcatttttttgtgtgcattattttacatctgctgaaactaaatgtgttattattgcactcattaaaaatgaaacaatccatttctcttggaaaaaaatgacaagctttagatgatgaaagcttaaattatccatcacttgcaaaatgaattcatataatttgtgaacattattaatgtaaatgagacatttctgcttagattttttttattttgatgggatcattatatggttgatcatatgtgtgtaggaagctgctgtacaattaacttggagatctgaaaatgctttttgtcctcattgttgcagtttcaattgtaatccattgcatctcattttcttgggtgttggcactgtaatatattaaaaaaaaattcagtgctcagtattgtaacaactgtccctactgaatattccttttcataaatacttgctaccacagggaaattaagttttcatatagaataactagtttcagtagtaaccattgaagaattaaaaatgtggttcaaggcagatatttttatgaaaagttttctctattgtaaaatttgttgtatatggctatgctactatcatggaataagaaaagaacaagcatacctcaaataaaaaaaaattctgagttaaaaaaa

SEQ ID NO: 134556 - DNA, 746 bp, Homo sapiens
  Payload ID: 6290
  Gene Symbol: FIGN
  Gene Name: fidgetin
  ENST ID: ENST00000409634
  CDS Start-End: 321-410
agctgttttgggtttgaaattccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatgcaacatggagacaatgttttcctgcattcttcattccagaagctgatggaggaaaggccctatgagctgtgggctggctctataggccccactgtactttagggaattccagtagcaaaggaataaaatcattttagtcactatgcactaatgtttccgttggtaaaacctctagccttcagttctatttgtacagtctttaatagtcaacctcatttttcttattttgaaaaaaatgttcttccctctaccttgtctttaaacccagtctatttcctgggacaggtctacatcattaaactgcagatggttctttttctattaagcagcaggtatcattcttgtcctgacaggaggaggctccacctgctgccggcccaccaatacttccagctgactgc

SEQ ID NO: 134557 - DNA, 3471 bp, Homo sapiens
  Payload ID: 6291
  Gene Symbol: FIGNL1
  Gene Name: fidgetin-like 1
  Uniprot ID: Q6PIW4
  ENST ID: ENST00000356889
  CDS Start-End: 312-2336
gccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcttt

SEQ ID NO: 134558 - DNA, 3485 bp, Homo sapiens
  Payload ID: 6291
  Gene Symbol: FIGNL1
  Gene Name: fidgetin-like 1
  Uniprot ID: Q6PIW4
  ENST ID: ENST00000395556
  CDS Start-End: 331-2355
gtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaa

SEQ ID NO: 134559 - DNA, 617 bp, Homo sapiens
  Payload ID: 6291
  Gene Symbol: FIGNL1
  Gene Name: fidgetin-like 1
  ENST ID: ENST00000440350
  CDS Start-End: 325-617
attttcctgcagtcactgctggcagatgatagagccaggatttgaaagcaggcagcctggctccagaccctgtgctcttaactcccgttttgcatcaagaacagaatcctatgaaaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtga

SEQ ID NO: 134560 - DNA, 559 bp, Homo sapiens
  Payload ID: 6291
  Gene Symbol: FIGNL1
  Gene Name: fidgetin-like 1
  ENST ID: ENST00000436590
  CDS Start-End: 184-559
cagaaccagactcatccaggattaggaagctggggcccggcgtggacggcaggctcggggccaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattca

SEQ ID NO: 134561 - DNA, 3626 bp, Homo sapiens
  Payload ID: 6291
  Gene Symbol: FIGNL1
  Gene Name: fidgetin-like 1
  Uniprot ID: Q6PIW4
  ENST ID: ENST00000433017
  CDS Start-End: 816-2840
acggcgcgagtccgagggcgacagcagcgcgcaggcgcacgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcct

SEQ ID NO: 134562 - DNA, 572 bp, Homo sapiens
  Payload ID: 6291
  Gene Symbol: FIGNL1
  Gene Name: fidgetin-like 1
  ENST ID: ENST00000448788
  CDS Start-End: 468-572
ttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgt

SEQ ID NO: 134563 - DNA, 582 bp, Homo sapiens
  Payload ID: 6291
  Gene Symbol: FIGNL1
  Gene Name: fidgetin-like 1
  ENST ID: ENST00000422854
  CDS Start-End: 276-582
agcagcgcgcaggcgcacgtcagtccccgcgcttttcggaggctgccagcgtcccacaccagccgcaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctg

SEQ ID NO: 134564 - DNA, 582 bp, Homo sapiens
  Payload ID: 6291
  Gene Symbol: FIGNL1
  Gene Name: fidgetin-like 1
  ENST ID: ENST00000420829
  CDS Start-End: 423-582
ttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtct

SEQ ID NO: 134565 - DNA, 593 bp, Homo sapiens
  Payload ID: 6291
  Gene Symbol: FIGNL1
  Gene Name: fidgetin-like 1
  ENST ID: ENST00000435566
  CDS Start-End: 208-411
ggcgcgagtccgagggcgacagcagcgcgcaggcgcacgtcagtccccgcgcttttcggaggctgccagcgtcccacaccagccgcaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagct

SEQ ID NO: 134566 - DNA, 3700 bp, Homo sapiens
  Payload ID: 6291
  Gene Symbol: FIGNL1
  Gene Name: fidgetin-like 1
  Uniprot ID: Q6PIW4
  ENST ID: ENST00000419119
  CDS Start-End: 1555-3579
ggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggtatggtagaaatttcaggataacagatgataaaggggaatgaagccatggagaggaagagaatgataatattaattgtgaaagtttgtgtcaagtgttttctgagtcacctttctttcagtttctcatttctagtattgtataaatgagtttaacatcaaaatggtatagtgaaaaaaaggatgaactgcttgacagaagaggtcagatctagttttgactctagcttatttagctttacagctttaaataaattacagtgtctttaaagctctggatcttaagttttctaattgttttttaaacaaagatttgtgaacacctacttacaatgtgacaaatgtctttgtaaggcattatgggagataaaagctgcattaaacctggctgttgtacttacaagtaatttggaaggcaaaatttcaaatacttgaacctaaagtagggtttcttggttttcatttaattgaaatactgttaggaaacaaaaatttttcataaatttttcttgtggatatgtaagtaaattctatatatctagcaatatgatacatctatagttctgtttaaaggtaacaatgtgaggaagcttatgcgaataacttgacagaagaaatctaaagtaaaagcattttcctagtaggctagcttgttctcttatttcatttattgtaacagtttcactttttaataattatgtgaaattaggaaacagatattctagggcattctgtttagggtgatgaacttattcatgaatgttattaaaaccatttaaatatgccatagtttaaatttgtgatccatgctgttcaatctgtgacctaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataa

SEQ ID NO: 134567 - DNA, 3187 bp, Homo sapiens
  Payload ID: 6291
  Gene Symbol: FIGNL1
  Gene Name: fidgetin-like 1
  Uniprot ID: Q6PIW4
  ENST ID: ENST00000613602
  CDS Start-End: 29-2053
ctggctgtgtgatcgcagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagctt

SEQ ID NO: 134568 - DNA, 3259 bp, Homo sapiens
  Payload ID: 6291
  Gene Symbol: FIGNL1
  Gene Name: fidgetin-like 1
  Uniprot ID: Q6PIW4
  ENST ID: ENST00000617389
  CDS Start-End: 101-2125
acggcgcgagtccgagggcgacagcagcgcgcaggcgcacgtcagtccccgcgcttttcggaggctgccagcgtcccacaccagccgcagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagctt

SEQ ID NO: 134569 - DNA, 3368 bp, Homo sapiens
  Payload ID: 6291
  Gene Symbol: FIGNL1
  Gene Name: fidgetin-like 1
  Uniprot ID: Q6PIW4
  ENST ID: ENST00000615084
  CDS Start-End: 210-2234
acggcgcgagtccgagggcgacagcagcgcgcaggcgcacgtcagtccccgcgcttttcggaggctgccagcgtcccacaccagccgcaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagctt

SEQ ID NO: 134570 - DNA, 3543 bp, Homo sapiens
  Payload ID: 6291
  Gene Symbol: FIGNL1
  Gene Name: fidgetin-like 1
  Uniprot ID: Q6PIW4
  ENST ID: ENST00000611938
  CDS Start-End: 385-2409
acggcgcgagtccgagggcgacagcagcgcgcaggcgcacgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagtaggcactccgtcagtattttagtagctattattccaaaggacactgtattctagatttaaagtattttctttgttttccttcatactgattttcatttttattgtttgttatagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagctt

SEQ ID NO: 134571 - DNA, 3011 bp, Homo sapiens
  Payload ID: 6292
  Gene Symbol: FIG4
  Gene Name: FIG4 phosphoinositide 5-phosphatase
  Uniprot ID: Q92562
  ENST ID: ENST00000230124
  CDS Start-End: 125-2848
agtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacattggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatt

SEQ ID NO: 134572 - DNA, 791 bp, Homo sapiens
  Payload ID: 6292
  Gene Symbol: FIG4
  Gene Name: FIG4 phosphoinositide 5-phosphatase
  ENST ID: ENST00000368941
  CDS Start-End: 6-425
caaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcgggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacatgtgtgtggagccatgtttttaataataactcctgtcctcacatttagagataatgaactgttgtcacagaaatctcataaatgcttaggttttcaggaggttttagtcctggaaggtagataatttagaagaggaatttccgttattcttatgtaataaatttatgtttaattttgactgttaaataaattatttttattttgcttca

SEQ ID NO: 134573 - DNA, 724 bp, Homo sapiens
  Payload ID: 6292
  Gene Symbol: FIG4
  Gene Name: FIG4 phosphoinositide 5-phosphatase
  ENST ID: ENST00000419951
  CDS Start-End: 428-724
gagcaaaaaggaatttaaagaacctcctctaaataactgcctgctcccattggacttcctgaggccctcctggctccttagagcttgttgaactcagctttgcattgtattttctatgcatctatctcatctcctttctaactgtgtaagtgttggaggcaggagcttaccctcggtcagggctgtatcccccacagagcttatcacagtgctgtctgtgaacacagttaatattatggaaatgtttgcttgctataatctcagacttttagagtaacatgcagtatctctcttagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgag

SEQ ID NO: 134574 - DNA, 439 bp, Homo sapiens
  Payload ID: 6292
  Gene Symbol: FIG4
  Gene Name: FIG4 phosphoinositide 5-phosphatase
  ENST ID: ENST00000415980
  CDS Start-End: 1-409
gttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagggttcctagcaagatctcctgcgaatctggaatgctccaattgaggactccatctagtcatgcttcagcatccc

SEQ ID NO: 134575 - DNA, 712 bp, Homo sapiens
  Payload ID: 6292
  Gene Symbol: FIG4
  Gene Name: FIG4 phosphoinositide 5-phosphatase
  ENST ID: ENST00000454215
  CDS Start-End: 1-712
atgagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaa

SEQ ID NO: 134576 - DNA, 12747 bp, Homo sapiens
  Payload ID: 6293
  Gene Symbol: FLG
  Gene Name: filaggrin
  Uniprot ID: P20930
  ENST ID: ENST00000368799
  CDS Start-End: 37-12222
cttttggtgaacaaggttcacatttattgccaaaagatgtctactctcctggaaaacatctttgccataattaatcttttcaagcaatattcaaaaaaagataaaaacactgacacattgagtaaaaaagagctgaaggaacttctggaaaaggaatttcggcaaatcctgaagaatccagatgacccagatatggttgatgtcttcatggatcacttggatatagaccacaacaagaaaattgacttcactgagtttcttctgatggtattcaagttggctcaagcatattatgagtctaccagaaaagagaatttaccgatatcaggacacaagcacagaaagcacagtcatcatgataaacatgaagataataaacaggaagaaaacaaagaaaacagaaaaagaccctcaagtctggaaagaagaaacaatagaaaagggaataagggaagatccaagagcccaagagaaacaggggggaaaaggcatgaatctagttctgaaaaaaaagaaagaaaaggatattcacctactcatagagaagaagaatatggaaaaaaccatcataactcaagtaaaaaagagaaaaacaagactgaaaatactagattaggagacaataggaagaggctaagtgaaagacttgaagagaaagaagacaatgaagaaggagtatatgattatgaaaatacaggaagaatgactcaaaaatggatacaatcaggccatattgccacatattacacaatccaggatgaagcctatgacaccactgatagtctattagaagaaaacaaaatatatgaaagatcaaggtcatctgatggcaaatcatcatctcaagtgaacaggtcaagacatgaaaatacaagccaggtaccattgcaggagtccaggacaagaaagcgtaggggatccagagttagccaggacagggacagtgagggacactcagaagactctgagaggcactctgggtcggcttccagaaaccatcatggatctgcgtgggagcagtcaagagatggctccagacaccccaggtcccatgatgaagacagagccagtcatgggcactctgcagacagctccagacaatcaggcactcgtcacgcagagacttcctctcgtggacagactgcatcatcccatgaacaggcaagatcaagtccaggagaaagacatggatccggccaccagcagtcagcagacagctccagacactcagccactgggcgcgggcaagcttcatctgcagtcagcgatcgtggacaccgggggtctagcggtagtcaggccagtgacagtgagggacattcagaaaactcagacacacaatcagtgtcaggccacggaaaggctgggctgagacagcagagccaccaagagtccacacgtggccggtcaggggaacggtctggacgttcagggtcttccctctaccaggtgagcactcatgaacagcctgactctgcccatggacggaccgggaccagcactggaggaagacaaggatcgcaccacgagcaggcacgagacagctccaggcattcagcgtcccaagagggtcaggacaccattcgtggacacccggggtcaagcagaggaggaaggcagggatcccaccacgagcaatcggtaaataggtctggacactcaggttcccatcacagccacaccacatcccagggaaggtctgatgcctcccatgggcagtcaggatccagaagtgcaagcagacaaacacgaaatgaggaacaatcaggagacggcaccaggcactcagggtcacgtcatcatgaagcttcctctcaggctgacagctctagacactcacaggtgggccagggacaatcatcggggcccaggacaagtaggaaccagggatccagtgttagccaggacagtgacagtcagggacactcagaagactctgagaggtggtctgggtctgcttccagaaaccatcatggatctgctcaggagcagtcaagagatggctccagacaccccaggtcccatcacgaagacagagctggtcatgggcactctgcagacagctccagaaaatcaggcactcgtcacacacagaattcctctagtggacaggctgcgtcatcccatgaacaggcaagatcaagtgcaggagaaagacatggatcccgccaccagctccagtcagcagacagctccagacactcaggcactgggcacggacaagcttcatctgcagtcagagacagtggacaccgagggtccagtggtagtcaggccactgacagtgagggacattcagaagactcagacacacagtcagtgtcaggccatggacaggctggtcaccatcagcagagccaccaagagtccgcacgtgaccggtcaggggaaaggtctcgacgttcagggtctttcctctaccaggtgagcactcataaacagtctgagtcctcccatggatggacagggcccagcactggagtaagacaaggatcccaccatgagcaggcacgagacaactccaggcactcagcatcccaagatggtcaggacaccattcgtggacacccggggtcaagcagaagaggaaggcaggggtcccaccacgagcaatcggtagataggtctggacactcagggtcccatcacagccacaccacatcccagggaaggtctgatgcctcccgtgggcagtcaggatccagaagtgcaagcagaacaacacgtaatgaggaacaatcaagagacggctccaggcactcagggtcacgtcaccatgaagcttcctctcatgccgacatctctagacactcacaggcaggccagggacaatcagaggggtccaggacaagcaggcgccagggatccagtgttagccaggacagtgacagtgagggacattcagaagactctgagaggtggtctgggtctgcttccagaaaccatcgtggatctgctcaggagcagtcaagacatggctccagacaccccaggtcccatcacgaagacagagccggtcacgggcactctgcagacagctccagacaatcaggaactcctcacgcagagacttcctctggtggacaggctgcgtcatcccatgaacaggcaagatcaagtccaggagaaagacacggatcccgccaccagcagtcagcagacagctccagacactcaggcattccgcgcagacaagcttcatctgcagtcagagacagtggacactgggggtccagtggtagtcaggccagtgatagtgagggacattcagaggagtcagacacacagtcagtgtcaggccatggacaggatgggccccatcagcagagccaccaagagtccgcacgtgactggtcagggggaaggtctggacgttcagggtctttcatctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtgcacacccggggtcaaggagaggaggaaggcagggatcccaccatgagcaatcggtagatagatctggacactcagggtcccatcacagccacaccacatcccagggaaggtctgatgcctcccatgggcagtcaggatccagaagtgcaagcagacaaactcgtaaggacaaacaatcaggagacggctccaggcactcagggtcacgtcaccatgaagctgcctcttgggctgacagctctagacactcacaggtgggacaggaacaatcatcggggtccaggacaagcaggcaccagggatccagtgttagccaggacagtgacagtgagagacactcagacgactccgagaggttgtctgggtctgcttccagaaaccatcatggatcttctcgggagcagtcaagagatggctccagacaccctgggttccatcaagaagacagagccagtcacgggcactctgcagacagctccagacaatcaggcactcatcacacagagtcttcctctcatggacaggctgtgtcatcccatgaacaggcaagatcaagtccaggagaaagacatggatcccgccaccagcagtcagcagacagctccagacactcaggcattgggcacagacaagcttcatctgcagtcagagacagtggacaccgagggtccagtggtagtcaggtcactaacagtgagggacattcagaagactcagacacacagtcagtgtcagcccacggacaagctgggccccatcagcagagccacaaagagtccgcacgtggccagtcaggggaaagctctggacgttcaaggtctttcctctaccaggtgagctctcatgaacagtctgagtccacacacggacagactgcacccagcactggaggaagacaaggatcccgccatgagcaggcacgaaacagctctaggcactcagcatcccaagacggtcaggacaccattcgtggacacccggggtcaagcagaggaggaaggcagggatcctaccacgagcaatcagtagataggtctggacactcagggtaccatcacagccacaccacaccccagggaaggtctgatgcctcccatgggcagtcaggacccagaagtgcaagcaggcaaacaagaaatgaggaacaatcaggagacggctccaggcactcagggtcacgtcaccatgaaccttccactcgggccggcagctctagacactcacaggtgggccagggagaatcagcggggtccaagacaagcaggcgccagggatccagtgttagtcaggacagggacagtgagggacactcagaagactctgagaggcggtctgagtcggcttccagaaaccattatggatctgctcgggagcagtcaagacatggctccaggaaccccaggtcccatcaagaagatagagccagtcatgggcactctgcagagagctccagacaatcaggcactcgtcatgcagagacttcctctggtggacaggctgcatcatcccaggaacaggcaaggtcaagtccaggagaaagacatggatcccgccaccagcagtcagcagacagctccacagactcaggcactgggcgcagacaagattcatctgtagtcggagacagtggaaaccgagggtccagtggtagccaggccagtgacagcgagggacactcagaagagtcagacacacagtcagtgtcagcccacggacaggctgggccccatcagcagagccaccaagagtccacacgtggccagtcaggggaaaggtctggacgttcagggtctttcctctaccaggtgagcactcatgaacagtctgagtccgcccatggacgcacagggcccagcactggaggaagacaaagatcccgccacgagcaggcacgagacagctccaggcactcagcgtcccaagagggtcaggacaccattcgtggacacccagggtcaagcagaggaggaaggcagggatcccactatgagcaatcggtagatagttctggacactcagggtctcatcacagccacaccacgtcccaggaaaggtctgatgtctcccgtgggcagtcaggatccagaagtgtcagcagacaaacacgtaatgagaaacaatcaggagacggctccaggcactcagggtcgcgtcaccatgaagcttcctctcgggccgacagctctagacactcgcaggtgggccagggacaatcatcagggcccaggacaagcaggaaccagggatccagtgttagccaggacagtgacagtcagggacactcagaagactctgagaggtggtctgggtctgcttccagaaaccatcttggatctgcttgggagcagtcaagagatggctccagacaccctgggtcccatcacgaagacagagccggtcacgggcactctgcagacagctccagacaatcaggcactcgtcacacagagtcttcctctcgtggacaggctgcgtcatcccatgaacaggcaagatcaagtgcaggagaaagacatggatcccaccaccagctccagtcagcagacagctccagacactcaggcattgggcatggacaagcttcatctgcagtcagagacagtggacaccgagggtacagtggtagtcaggccagtgacagtgagggacattcagaagactcagacacacagtcagtgtcagcacagggaaaagctgggccccatcagcagagccacaaagagtccgcacgtggccagtcaggggaaagctctggacgttcagggtctttcctctaccaggtgagcactcatgaacagtctgagtccacccatggacagtctgcgcccagcactggaggaagacaaggatcccattatgatcaggcacaagacagctccaggcactcagcatcccaagagggtcaggacaccattcgtggacacccggggccaagcagaggaggaagacaggggtcccaccaagagcaatcggtagataggtctggacactcagggtctcatcacagccacaccacatcccagggaaggtctgatgcctcccgtgggcagtcaggatccagaagtgcaagcagaaaaacatatgacaaggaacaatcaggagatggctctaggcactcagggtcgcatcatcatgaagcttcctcttgggccgacagctctagacactcactggtgggccagggacaatcatcagggcccaggacaagcaggccccggggatccagtgttagccaggacagtgacagtgagggacactcagaagattctgagaggcggtctgggtctgcgtccagaaaccatcatggatctgctcaggagcagtcaagagatggctccagacaccccaggtcccatcacgaagacagagccggtcatgggcactctgcagagagctccagacaatcaggcactcatcatgcagagaattcctctggtggacaggctgcatcatcccatgaacaggcaagatcaagtgcaggagagagacacggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtccgcccatggacggaccgggaccagcactggaggaagacaaggatcccaccacaagcaggcacgagacagctccaggcactcaacgtcccaagagggtcaggacaccattcatggacacccggggtcaagcagtggaggaaggcagggatcccactacgagcaattggtagatagatctggacactcagggtctcatcacagccacaccacatcccagggaaggtctgatgcctcccatgggcactcaggatccagaagtgcaagcagacaaactcgtaacgatgaacaatcaggagacggctccaggcactcagggtcgcgtcaccatgaagcttcctctcgggccgacagctctggacactcgcaggtgggccagggacaatcagaggggcccaggacaagcaggaactggggatccagttttagccaggacagtgacagtcagggacactcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaagacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacggctccaggcactcagggtcgcgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccaccagcagtcagcagacagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcaggggaaacgtctggacattcaggatctttcctctaccaggtgagcactcatgaacagtctgagtcctcccatggatggacggggcccagcactagaggaagacaaggatcccgccatgagcaggcacaagacagctccaggcactcagcatcccaatacggtcaggacaccattcgtggacacccggggtcaagcagaggaggaaggcaggggtaccaccacgagcattcggtagatagctctggacactcagggtcccatcacagccacaccacatcccagggaaggtctgatgcctcccgtgggcagtcaggatccagaagtgcaagcagaacaacacgtaatgaggaacaatcaggagacagctccaggcactcagtgtcacgtcaccatgaagcttccactcatgccgacatctctagacactcacaggcagtccagggacaatcagaggggtccaggagaagcaggcgccagggatccagtgtgagccaggacagtgacagtgagggacattcagaagactctgagaggtggtctgggtctgcttccagaaaccatcgtggatctgttcaggagcagtcaaggcacggctccagacaccccaggtcccatcacgaagacagagccggtcacgggcactctgcagaccgctccagacaatcaggcactcgtcacgcagagacttcctctggtggacaggctgcatcatcccatgaacaggcaagatcaagtccaggagagagacacggatcccgccaccagcagtcagcagacagctccagacactcaggcattccgcgtggacaagcttcatctgcagtcagagacagtagacactgggggtccagtggtagtcaggccagtgatagtgagggacattcagaagagtcagacacacagtcagtgtcaggccatggacaggctgggccccatcagcagagccaccaagagtccgcacgtgaccggtcagggggaaggtctggacgttcagggtctttcctctaccaggtgagcactcatgaacagtctgagtctgcccatgggcggaccaggaccagcactggacgaagacaaggatcccaccacgagcaggcacgagacagctccaggcactcagcgtcccaagagggtcaggacaccattcgtggacacccggggtcaagcagaagaggaaggcagggatcccactacgagcaatcggtagataggtctggacactcagggtcccatcacagccacaccacatcccagggaaggtctgatgcctcccgtgggcagtcaggatccagaagtgccagcagacaaactcgtaatgacgaacaatcaggagatggctccaggcactcatggtcgcatcaccatgaagcttccactcaggcggacagctctagacactcacagtccggccagggacaatcagcggggcccaggacaagcaggaaccagggatccagtgttagccaggacagtgacagtcagggacactcagaagactctgagaggtggtctgggtctgcttccagaaaccatcgtggatctgctcaggagcagtcaagagatggctccagacaccccacgtcccatcacgaagacagagccggtcacgggcactctgcagagagctccagacaatcaggcactcatcatgcagagaattcctctggtggacaggctgcatcatcccatgaacaggcaagatcaagtgcaggagagagacatggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtctgcccatggacgggctgggcccagtactggaggaagacaaggatcccgccacgagcaggcacgagacagctccaggcactcagcgtcccaagagggtcaggacaccattcgtggacacccggggtcaaggagaggaggaagacagggatcctaccacgagcaatcggtagataggtctggacactcagggtcccatcacagccacaccacatcccagggaaggtctgatgcctcccatgggcagtcaggatccagaagtgcaagcagagaaacacgtaatgaggaacagtcaggagacggctccaggcactcagggtcgcgtcaccatgaagcttccactcaggctgacagctctagacactcacagtccggccagggtgaatcagcggggtccaggagaagcaggcgccagggatccagtgttagccaggacagtgacagtgaggcatacccagaggactctgagaggcgatctgagtctgcttccagaaaccatcatggatcttctcgggagcagtcaagagatggctccagacaccccggatcctctcaccgcgatacagccagtcatgtacagtcttcacctgtacagtcagactctagtaccgctaaggaacatggtcactttagtagtctttcacaagattctgcgtatcactcaggaatacagtcacgtggcagtcctcacagttctagttcttatcattatcaatctgagggcactgaaaggcaaaaaggtcaatcaggtttagtttggagacatggcagctatggtagtgcagattatgattatggtgaatccgggtttagacactctcagcacggaagtgttagttacaattccaatcctgttgttttcaaggaaagatctgatatctgtaaagcaagtgcgtttggtaaagatcatccaaggtattatgcaacgtatattaataaggacccaggtttatgtggccattctagtgatatatcgaaacaactgggatttagtcagtcacagagatactattactatgagtaagaaattaatggcaaaggaattaatccaagaatagaagaatgaagcaagttcactttcaatcaagaaacttcataatactttcagggaagttatcttttcctgtcaatctgtttaaaatatgctatagtatttcattagtttggtggtagcttatttttattgtgtaatgatctttaaacgctatatttcagaaatattaaatggaagaaatcaatatcatggagagctaactttagaaaactagctggagtattttaggagattctgggtcaagtaatgttttatgtttttgaaagtttaagttttagacactccccaaatttctaaattaatctttttcagaaatatcgaaggagccaaaaatataaaacagttctgtataccaaagtggctatatcaacatcagggctagcacatctttctctattatccttctattggaattctagtattctgtattcaaaaaatcatcttggacataattaatattatagtaagctgcatctaaattaaaaataaactatt

SEQ ID NO: 134577 - DNA, 9124 bp, Homo sapiens
  Payload ID: 6294
  Gene Symbol: FLG2
  Gene Name: filaggrin family member 2
  Uniprot ID: Q5D862
  ENST ID: ENST00000388718
  CDS Start-End: 74-7249
accctgcaagctgcatcaggctttatcctacttgttcctttggtgaaccaggttcacttaaacttgcaaaaagatgaccgacctcttgagaagtgttgtcaccgtaattgatgttttctacaaatacaccaagcaagatggggagtgtggcacactgagcaagggtgaactaaaggaacttctggagaaagagcttcatccagttctgaagaacccagatgatccagacacagtggatgtcatcatgcatatgctggatcgagatcatgacagaagattggactttactgagtttcttttgatgatattcaagctgactatggcctgcaacaaggtcctcagcaaagaatactgcaaagcttcagggtcaaagaagcataggcgtggtcaccgacaccaagaagaagaaagtgaaacagaagaggatgaagaggatacaccaggacataaatcaggttacagacattcaagttggagtgagggagaggagcatggatatagttctgggcactcaaggggaactgtgaaatgtagacatgggtccaactccaggaggctaggaagacaaggtaatttatccagctctgggaaccaagagggatctcagaaaagataccacaggtccagctgtggtcattcatggagtggtggcaaagacagacatggttccagctctgtagaactgagagaaagaataaacaagtcacacattagcccttctagggaatctggggaggagtatgaatctggatctggatcaaacagttgggaaaggaaaggtcatggtggtctgtcatgtggattggagactagtgggcatgaatcaaactctactcagtcaagaattagagaacaaaagcttgggtctagctgttcaggttcaggagacagtgggaggcgaagtcatgcatgtggttatagcaattcaagtgggtgtggaaggccacaaaatgcttcaagttcttgtcagtcacatagatttggagggcaaggaaatcaatttagctatattcagtcaggctgtcagtcaggaattaagggaggacaaggccatggctgtgtctcaggaggtcagccctctggatgtggtcaacctgagtctaacccctgtagtcagtcctatagtcagagaggatatggagctagagaaaatggtcaaccacagaactgtggaggacaatggagaacaggctcaagtcagtcctcttgctgtggacaatatgggtctggaggtagccagtcttgtagtaatggtcaacatgaatatggttcctgtggccgcttttcaaactcttctagttcaaatgaattttccaaatgtgatcaatatgggtctggttcaagtcagtctactagctttgaacaacatggaacaggcttgagtcagtcctctgggttcgaacaacatgtatgtggctcaggtcaaacttgtggccagcatgagtctacatcaagtcaatccttgggctatgaccagcatgggtctagctcaggtaagacatctggctttggacaacatgggtctggctcaggtcagtcctctggctttggacaatgtgggtcaggctcaggtcagtcctctggctttggacagcatgggtctgtctcaggacaatcctctggttttggacagcatgggtctgtctcaggacaatcctctggttttggacaacatgagtctagatcacgtcagtctagctatggccaacatggttctggctcaagtcaatcatctggctatggccaatatgggtctagagagacatctggctttggacaacatgggttgggctcaggtcaatccactggctttggccaatatggatcgggctcaggtcagtcctctggctttggacaacatgggtctggctcaggacaatcctctggctttggacaacatgagtctagatcaggtcagtctagttatggccaacacagttctggctcaagtcagtcatctggctatggccaacatgggtctagacagacatctggctttggacaacatgggtcaggctcaagtcaatccactggctttggccaatatggatcaggctcaggtcagtcctctggctttggacaacatgtttctggctcaggacaatcctctggttttggacaacatgagtctagatcaggtcattctagctatggccaacatggttttggctcaagtcaatcatctggctatggtcaacatgggtcaagttcaggacagacatctggatttggacaacacgagttaagctcaggtcagtcttccagctttggccaacatggatcaggctcaggtcagtcctctggctttggacaacatgggtctggctcaggacaatcctctggctttggacaacatgagtctagatcaggtcagtctagctatggccaacacagttctggctcaagtcagtcatctggctatggccaacatgggtctagacagacatctggctttggacaacatgggtcaggctcaagtcaatccactggctttggccaatatggatcaggctcaggtcagtccgctggctttggacaacatgggtctggctcaggacaatcctctggctttggacagcatgagtctagatcacatcagtccagctatggccaacatggttctggctcaagtcaatcatctggctatggtcaacatgggtcaagttcgggacagacatctggctttggacaacacaggtcaagctcaggtcaatactctggctttggacaacatggatcaggctcaggtcagtccagtggctttggacaacatgggactggctcaggacaatactctggttttggacaacatgagtctagatcacatcagtctagctatggccaacatggttctggctcaagtcagtcatctggctatggtcaacatgggtcaagttcaggacagacttttggatttggacaacacaggtcaggctcaggtcaatcctctggctttggccaacatggatcaggctcaggtcagtcctctggctttggacaacatgagtcaggctcaggaaaatcctctggctttggacagcatgagtctagatcaagtcagtctaattatggccaacatggttctggctcaagtcagtcatctggctatggtcaacatgggtctagttcaggacagacaactggctttggacaacacaggtcaagctcaggccaatactcaggctttggacaacatggatcaggctcagatcagtcctctggctttggacaacatgggactggttcaggacaatcctctggttttggacaatatgagtctagatcacgtcagtctagctatggccaacatggttctggctcaagtcaatcatctggctatggtcaacatgggtcaaattcaggacagacatctggatttggacaacacaggccaggctcaggtcagtcctctggctttggccaatatggatcgggctcaggtcagtcttctggctttggacaacatgggtcaggcacaggtaaatcctctggctttgcacagcatgagtacagatcaggtcagtctagctatggccaacatggtactggctccagtcaatcatctggctgtggccaacatgagtctggctcaggtccaaccacaagttttggacagcatgtgtctggctcagacaatttctctagttctggacaacatatatctgactcaggtcagtccactggatttggccaatatggttcaggctcaggtcaatcaactggcttgggccagggtgaatctcaacaagtagagtcaggatccacagttcatgggagacaggaaactactcatggtcagacaataaataccactagacatagccagtctggtcaaggacaatccacacagacagggtccagggtaactagaagacgaagatctagccaaagtgagaacagtgacagtgaagtgcactcaaaggtctcacacagacattcagaacacattcacacacaagctggatctcactacccaaagtcaggatccacagttcgcagaagacaaggaactactcatggacagagaggagataccactagacatggccattctggtcatggacagtctacacagacaggttccagaacatctggaagacagagatttagccacagtgatgccactgacagtgaagtgcactcaggggtctcacatagaccacactcacaagaacaaactcacagccaagctggatctcaacatggagagtcagaatccacagttcatgagagacatgaaactacttatggacagacaggagaggccactggacatggccactctggtcatggacagtccacacagagagggtccaggacaactggaagaaggggatctggccatagtgagtccagtgacagtgaagtgcactcagggggctcacacagaccacaatcacaagaacaaactcatggccaagccggatctcaacatggagagtcaggatccacagttcatgggagacacggaactactcatggacagacaggagataccactagacatgcccactatcatcatggaaaatccacacagagagggtccagtacaactggaagaaggggatctggccacagtgagtccagtgacagtgaagtgcactcagggggctcgcacacacattcaggacacactcacggccaaagtggatctcaacatggagagtcagaatccataattcatgacagacacagaattactcatggacagacaggagataccactagacattcctactctggtcatgaacaaaccacacagacagggtccaggacaactggaagacagagaactagccacagtgagtccactgacagtgaagtgcactcagggggctcacacagaccacactcacgagaacacacttacggccaagccggatctcaacatgaagagccagaattcacagttcatgagagacacggaactactcatggacagataggagataccactggacattcccactctggtcatggacagtccacacagagagggtccaggacaactggaagacagagatctagccacagtgagtccagtgacagtgaagtgcactcaggggtctcacacacacatacaggacacactcatggtcaagctggatctcaacatggacagtcagaatccatagttcctgagagacatggaactactcatggacagacaggagataccactagacatgcccactatcatcatggattaaccacacagacagggtccaggactactggaagaaggggatctggccacagtgagtacagtgacagtgaagggtactcaggagtctcacatacacattcaggacacactcatggccaagccagatctcaacatggagagtcagaatccatagttcatgagagacatggaactatacatggacagacaggcgataccaccagacatgcccactctggtcatggacagtccacacagacagggtccaggaccactggaagaaggtcatctggccacagtgagtacagtgacagtgaagggcactcagggttctcacaaagaccacactcacgaggacacactcacggccaggctggatctcaacatggagagtcagaatccatagttgacgagagacatggaactactcatggacagacaggagataccagtggacattctcaatctggtcatggacagtccacacagtcaggatccagtacaactggaagaaggagatctggccacagtgagtccagtgacagtgaagtgcactcagggggctcacatacacattcaggacacacacacagccaagccaggtctcaacatggagagtcagaatccacagttcacaagagacaccaaactactcatggacagacaggagataccactgaacatggccaccctagtcatggacaaaccatacagacagggtccaggacaactggaagaaggggatctggccacagtgagtacagtgacagtgaagggccctcaggggtctcacacacacattcaggacacactcacggtcaagctggatctcactatccagagtcaggatcctcagttcatgagagacacggaactactcatggacaaacagcagataccactagacatggccactctggtcatggacagtccacacagagagggtccaggacaactggaagaagggcatctggccacagtgagtacagtgacagtgaagggcactcaggggtctcacacacacattcaggacacgctcatggccaagccggatctcaacatggagagtcaggatcctcagttcatgagagacacggaactactcatggacagacaggagataccactagacatgctcactctggtcatggacagtccacacagagagggtcaaggacagctggaagaaggggatctggccacagtgagtccagtgacagtgaagtgcactcaggggtctcacacacacattcaggacacacttatggccaagccagatctcaacatggagagtcaggatctgccattcacgggagacagggaactatacatggacagacaggagataccactagacatggccagtctggtcatggacagtccacacagacaggttccaggacaactggaagacaaagatctagtcacagtgagtccagtgatagtgaagtgcactcagaggcctcacccacacattcaggacacactcacagccaagccggatctcgacatggacagtcaggatcctcaggtcatgggagacagggaactactcatggacagacaggagataccactagacatgcccactatggttatggacaatccacacagagagggtccaggacaactggaagaaggggatctggccacagtgagtccagtgacagtgaagtgcactcatggggctcacacacacattcaggacacattcagggccaagctggatctcaacaaagacagccaggatccacagttcatgggagactggaaactactcatggacagacaggagataccactagacatggccattctggttatggacaatccacacagacaggttccagatctagtagagcaagtcattttcagtcacatagtagtgaaaggcaaaggcatggatcaagtcaggtttggaaacatggcagctatggacctgcagaatatgactatgggcacactgggtatgggccttctggtggcagcagaaaaagcatcagtaattctcacctttcatggtcaacagacagcactgcaaacaagcaactgtctagacattgacagttattttctagttctgaccttatagtatccaaagcaactaaaagaacaggaagacacagtttaaatcatgaacagtcaatggtaagttatgaacattcagttgattctcagtatcagtctcgacctattattataagaagtcaggaatctagtcatggacattctatagtaactcataaacagtcaaacaacacctatgttcaacctggatataacacagccagaagggagggatgtacacatagccagtcaaatgaccaccttggatttggccatggacaatccatatcagttcatggccattcaaaatctagttcaatcagaaaacaggaatcccatactgataacaaaaagcattcagaagattgggagaaagacactcatgagcaattaggatctaggcatgggaagttagagttcaatacaataggtatacatggatctagccagcaacatttcggagatacaacttttcatgggcaggtaagatccagcacaggttttgccagataggtattaagtcatgggccatcaagagatgcctagggtcagtctggattcagtaccaatgaaagacaagtatacagccatggccaatcaaatgatagttatgagtagtcaaatgacagcaaaagtcaaagatacattttcagtcactttcttgacagccaagaccctgcaggaattgaagagtataggtatagatattcatcaagcagtgcaaccatatgcagtgggggagacaaaggcaagagtcagagtcaagtctgtcaggaggtatcagaatatacggtgaggatgtgggcaaaaaacaaagaggctctgaggccagcggttaccatacaaaggaaagaacaggctctggttccttctgcttagatagcaacaccccactctatgaatatgtccaagaacaaaggagttattactttgaataagaagccaacataaactagcccaagataagaactaacccagagaagaaatgagacacatacatgaaattaaggtatttaacatgatctcctcttttggtagtaagggtatatgtctgttctttcattttaactatagttctgtactatattacttttgtttggtgccaggtgtttttgtaaggctccacattcattgaactccttggttagaaaatagtgaatgaggccgggcgcggtggctcacgcctgtaatcccagcactttgggaggccaagatgggtggatcacgaagtcaggagttcgagaccagcctggccaacatagtgaaatcccgtctctactaaaaatacaaaaattagctgggtgcagtagcgggcacctgtaatcctagctactcaggaggctgaggcaggagaattggttgaacccgggaggcagaggttgcagtgagccgagatcgcaccactgcactccagcctgggtgactgagcaagactccaccttgaaaaaaagaaagaaagaaaatagtgaatggaagaaaaagataaacaccatttggggctatattcagaactatataataaagagagatttgtgtggttgggaataaaattaggttttaaaaaaatttccgaatttcaaaatttggattttccagattttgttttaattaattattgacaaacctatccaaggagctaaatgacgtggtttaggagccaaaacgtctctagaaacattataacacatcccatcctgaacaaagaatgttgtcatagtttcccacatgaatattcagaatatttgcatctttttgtgtcactactggaattctgtacaattatatttaaatttattgtcatggccttctggatataggatccagaaaattgtacttcataaaaattggcaataaacatttcatcaagttata

SEQ ID NO: 134578 - DNA, 4580 bp, Homo sapiens
  Payload ID: 6295
  Gene Symbol: FILIP1
  Gene Name: filamin A interacting protein 1
  Uniprot ID: Q7Z7B0
  ENST ID: ENST00000237172
  CDS Start-End: 332-3973
acccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaa

SEQ ID NO: 134579 - DNA, 4051 bp, Homo sapiens
  Payload ID: 6295
  Gene Symbol: FILIP1
  Gene Name: filamin A interacting protein 1
  ENST ID: ENST00000370020
  CDS Start-End: 108-3452
attcaataagctctctgttgattttttgagcccagtatgcgatttacattgtcagtcgtctgatcttgctgcactttctattacaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatgg

SEQ ID NO: 134580 - DNA, 7807 bp, Homo sapiens
  Payload ID: 6295
  Gene Symbol: FILIP1
  Gene Name: filamin A interacting protein 1
  Uniprot ID: Q7Z7B0
  ENST ID: ENST00000393004
  CDS Start-End: 223-3756
gctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaagaaagcatcatcattcaccagttacgaatgaactccagatgaaatggtaaaccaagcacatactgggtgtgtgtacgacctctgaatccctattgaatggacagccctcaatcatgactaaggtcctccatgctactgatcactactggaaatattttactacttccagtgatttttttttaaggatataatgtaaaaagctgaaaatggccttgctgataatatgaaaatatgtagcaagagcaattcaatctatgtgccaaaagaaatttctttttgcaaagctttcaggtctatgggcacatgctgtataacttatattttataatacattttgtaatgtgattttttttgctaaagtgtttccctttttcatagtctctggcacatatatctatggaatacgctgtcagttcttcaaagtactggtattgttgcattcaaaatggtaatctataattattttctttttatcaatttgttaattctgaaaaaaagaaagtacaactatatttcctgaggtaaattcaagaggtaaaacttagaagcaggagactctggaagaggttttactattgcttgtacaatgctatggttctgatcatggttcaatgctaacaaataatgctctgacttaaaagcttaattttaaatactaaaaatcagtttctaaagttgctctttctggtgttctgggccaaaaaccttggatgaaatgatttttatatagaacaaattcataaaaggagatgtaccagtttaaccagtaagggcaataagaacagcttcgactgacagttcaattatacttctgattgcattatttacttgtatgtataagacttataataaggactgtgaaataaagatagttctcacaatctaatccaatcaaaacttgaatataaaaacagacctaaaatgtcaggatcttttttaaaaaataagactgggcatggtgggtcgtgcctgtaatcccagcactttgggaggccaaggcgggagaatcgcttaagcccaggagttcaggatcagcctgggcaacacagtgagagtcttaaaaaaaaaaaaaaaaaaaaaaaaaaaaagaagttagctgggcctgattgcacgtgcctgtagtcctagctacttgggagtctgaggtgggaggatcacttgagcccaggagatggaggctgcagggagccatgattgtgtcactgtactccagcctgggtgacagagtgagactctgtctcaaaacaaagacaaacccacacacacacaaaaacccccaaaacccagaaggaaaaagtagtacaagaaatctcaggatcgataacttttttccccttgattttgaaagattttcgtaactacaggtaggtcagagaatatattctttgaagataaaaagcacaacgtgcattactcaaatctcaacgtcagagctactgttgaatttaggtttatgtgaaaatgtgcatctaaagtctacttgaaaccctggtaatatacttttttttttaaagactgttaatatggacatgtttttagtaaggtctttaaagataactttaaagataaattaagagttgacacatcagtttctgaatgtggaagtcatttatcatgtaactttactgaaattaaagagagaatgcttctgagtgtcacaaggataactaaaagccacacaaggaggactgctggcccatttctctagttcacaggttgtgctcagctttagaagcccacacacgggcatccaaactgagtctctggaatagaaaaattaatgatggacttcctcccctatgtaaccttggaaggttttaagttacaccttggggaattggcaaatcattttcaacatgtattataaattatatgatgttaaaattatttttaattttttaaagtaaaagaaatgttacagtaggcttgccatagcttgaatgattgtgaaaacatcacataaacttccagaattttggttactaagaaaactggagtgtgtatgtgtgattttttagaattgttactgggttttgttttctgaaaatgttgactgtaatgacattttcaattagaaaagtgttttagttagtactgttatattttttgactcacagttaagtatcctatttgccaatgtttgtacctctgatggcaaaattatttgatatattagattagtatttgaagcaaataactttctcaacttgtgggaattttattatactaatagtgaaaatgttagaggataagattttaaatacttcttgatttaaattaaaatactataagaaatgtatgtatatttggatttgaagattttttttccccagatttataatgaatttggaacttacaagaacaatgaggatgatggtgcaatcagagtcatttagatagatggtgagccttttctgtccatgctatgattaagtcctctgtttaaacccaaatgcaatctgagtgacacatgaataaaattaattagattaattttgaaataagagaatatgcaaaattaaccaaaaaacccccagaaaacactggtcatctccttctctaatgaataaggaaataagatcataaatagtcccatctcaacatgcatatgcaattgaaaaaactgccctcacaggcaatcctggcacaatcctaggctcataaaatttctctatcttttcttgtaaataagtctccagtcatcattctaaatgggaatcatttttaatgaaataattataactgttttctgaaatataatcataatcagtgtttctagttcaaggtacaattgaactaatccataattttacccttttctttttgataagagagtgtttcatgagggtatctttggtagagatcttttctcaagtattttataaaatattcgagtttgatgaagatggtagataaatacaccagctgtcagatgcctataattttcacaaaatgtgaagaattcattgtatcttaggatgaccataaaaaaattcatggtgtggaatctctaagcattaatagagacaacagcgctactgcagtaatacacagctactacaaatcagtggcagagcaagaataagtggtgtatcaggcaatgtgaagtttttgccttttctcctaatgctgtggttgagttttcctggaaatgaaggaaaaaaacatagcaaaagtagggtgtgttaatgaatctgatgagcaacaagtctaaaaatagcaaaagtgcaaaatggaagttaaaaaacgcaactggcacctgaagcatatttccccttctttatctccagtgctatgcctctgctaaaaatatgaatcacaaagcaaaggaaaaagagaaaaaaagtgttgtaatacagtaaaaatcactataataaaagtttataagaattgagttttttggaattgactttggcctagtaaccattagtatttcttaatttttcagcatttattccatactaatgtgataacaactgtgtgtgttacctagagaaaatgctgtagatccacacatttgaacagaaatgtttatcgatgccataacgtgatacatttgctttccggtgttgttttttgtttatattatttagggaaattttaccttaccatcacagattttgttactttaataatgcagaactatatttatttaatctagattttgttttaaaattatcaagtgttagcttttacaaataagaggcttataatgtggccagatattcttagaattcttttaggtctaagtgttttcaaaactttaagaaatacattctatttttgcaccatttaaaattttgtttccttttaagttttattaagtacacgagaagtttattatttttcattgaatccaagtgaatttatggatatgtacttatcttttatatgaatgtaatagcttgctttcagttcctcacaggtcattgaaattatttaaccaatgaaaacattctctgttacttccaaagtcaactatgtttatcaaaatctcactagtgtgagaaaaataacaagtgtaatattaaagcattgtgcaatatcttgagttggaacataatattcagaaaattaaaatcatttaaaatga

SEQ ID NO: 134581 - DNA, 4219 bp, Homo sapiens
  Payload ID: 6296
  Gene Symbol: FILIP1L
  Gene Name: filamin A interacting protein 1-like
  Uniprot ID: Q4L180
  ENST ID: ENST00000331335
  CDS Start-End: 472-3873
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 134582 - DNA, 3970 bp, Homo sapiens
  Payload ID: 6296
  Gene Symbol: FILIP1L
  Gene Name: filamin A interacting protein 1-like
  Uniprot ID: Q4L180
  ENST ID: ENST00000354552
  CDS Start-End: 472-3879
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagacttttaaggcattccaaatcccagtcttcatgttgaactgggttaagcatttattaaaaaatcgttttcttcta

SEQ ID NO: 134583 - DNA, 3280 bp, Homo sapiens
  Payload ID: 6296
  Gene Symbol: FILIP1L
  Gene Name: filamin A interacting protein 1-like
  Uniprot ID: Q4L180
  ENST ID: ENST00000383694
  CDS Start-End: 248-2929
cataggccgggcgcgctcagcgccccgctcgcattgttcgggcgactctcggagcgcgcacagtcggctcgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttatttttaccatt

SEQ ID NO: 134584 - DNA, 1712 bp, Homo sapiens
  Payload ID: 6296
  Gene Symbol: FILIP1L
  Gene Name: filamin A interacting protein 1-like
  Uniprot ID: Q4L180
  ENST ID: ENST00000398326
  CDS Start-End: 472-1239
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaagatggagtctagctctgctgccgaggctggagtgcaatggcatgatcttggctcactgcaatctctgcctcctgggttcaagtgattctcctgcctcagcattccaagtagctgggattacaggcacccgccatcatgcccagctagtttttgtatttttgtagagacagagtttcaccatgttggccaggctagtcttgaacccctgacctcaggtgatccacccacctcggcctcccaaagtgctgggataacaggcatgagccaacgcgcttgacttgcacatatatttttaatgtgtgagtgggtgcatgtcataattccagatggaaatttgtcaccacaaaacataatttttatttagctgatctttccaggtttctatttataatggaatgaaaagatgaagttgggcttatgaatcaagacaaacacaggccctggtcattgtgtaattccatatagtataatttgtttgcaatctttcattccatacacctacaatacagctctaaaaataatgctacctacaatataaagatatactttttttccaaataaccttcaaaaatgtcaaaatatgcaacaaaaatattgtatcatatctaaaccctcaaataagctacatttaaaccaa

SEQ ID NO: 134585 - DNA, 445 bp, Homo sapiens
  Payload ID: 6296
  Gene Symbol: FILIP1L
  Gene Name: filamin A interacting protein 1-like
  ENST ID: ENST00000477258
  CDS Start-End: 1-445
ccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacaatcaaggaggtatgcaagcagagaatcccagcacggatccctaaaccgaaatctacaggcatcaccaagatttccactaaagcccccacagtgcctatggataagcctatttaccaaaatggctgtg

SEQ ID NO: 134586 - DNA, 2321 bp, Homo sapiens
  Payload ID: 6296
  Gene Symbol: FILIP1L
  Gene Name: filamin A interacting protein 1-like
  Uniprot ID: Q4L180
  ENST ID: ENST00000487087
  CDS Start-End: 168-2303
ttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 134587 - DNA, 2854 bp, Homo sapiens
  Payload ID: 6296
  Gene Symbol: FILIP1L
  Gene Name: filamin A interacting protein 1-like
  Uniprot ID: Q4L180
  ENST ID: ENST00000471562
  CDS Start-End: 149-2836
ggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtggaaccacttcttctgcctcattgaactcaacatccttcagac

SEQ ID NO: 134588 - DNA, 2898 bp, Homo sapiens
  Payload ID: 6296
  Gene Symbol: FILIP1L
  Gene Name: filamin A interacting protein 1-like
  ENST ID: ENST00000495625
  CDS Start-End: 388-2898
acagtcggctcgcagcgcggcactacagcggccccggcccggcccccgcccggccccggcgcaggcagttcagggaagcccaccataatgagaagagcggggccaacacccatgtcactgtggagaagtacagaatatgcaatggaagagttgtttatctgatataagcggtaattggaaactgaaaaattcctgctctggaaaaaagatattctgctcttctgaatctaacagaggaagagacaaacagaaaccatcaattattgtttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccct

SEQ ID NO: 134589 - DNA, 8281 bp, Homo sapiens
  Payload ID: 6297
  Gene Symbol: FLNA
  Gene Name: filamin A, alpha
  Uniprot ID: P21333
  ENST ID: ENST00000360319
  CDS Start-End: 39-7958
ggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctt

SEQ ID NO: 134590 - DNA, 7932 bp, Homo sapiens
  Payload ID: 6297
  Gene Symbol: FLNA
  Gene Name: filamin A, alpha
  ENST ID: ENST00000344736
  CDS Start-End: 44-7867
gccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctct

SEQ ID NO: 134591 - DNA, 8382 bp, Homo sapiens
  Payload ID: 6297
  Gene Symbol: FLNA
  Gene Name: filamin A, alpha
  Uniprot ID: P21333
  ENST ID: ENST00000369850
  CDS Start-End: 238-8181
gcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagcca

SEQ ID NO: 134592 - DNA, 8241 bp, Homo sapiens
  Payload ID: 6297
  Gene Symbol: FLNA
  Gene Name: filamin A, alpha
  ENST ID: ENST00000369856
  CDS Start-End: 59-7921
gggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctc

SEQ ID NO: 134593 - DNA, 843 bp, Homo sapiens
  Payload ID: 6297
  Gene Symbol: FLNA
  Gene Name: filamin A, alpha
  ENST ID: ENST00000444578
  CDS Start-End: 1-843
ctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcag

SEQ ID NO: 134594 - DNA, 696 bp, Homo sapiens
  Payload ID: 6297
  Gene Symbol: FLNA
  Gene Name: filamin A, alpha
  ENST ID: ENST00000438732
  CDS Start-End: 1-696
gcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagagggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgg

SEQ ID NO: 134595 - DNA, 704 bp, Homo sapiens
  Payload ID: 6297
  Gene Symbol: FLNA
  Gene Name: filamin A, alpha
  ENST ID: ENST00000415241
  CDS Start-End: 1-272
atgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctg

SEQ ID NO: 134596 - DNA, 8225 bp, Homo sapiens
  Payload ID: 6297
  Gene Symbol: FLNA
  Gene Name: filamin A, alpha
  ENST ID: ENST00000420627
  CDS Start-End: 1-1815
gcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttg

SEQ ID NO: 134597 - DNA, 8486 bp, Homo sapiens
  Payload ID: 6297
  Gene Symbol: FLNA
  Gene Name: filamin A, alpha
  Uniprot ID: P21333
  ENST ID: ENST00000422373
  CDS Start-End: 250-8169
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccatt

SEQ ID NO: 134598 - DNA, 7595 bp, Homo sapiens
  Payload ID: 6297
  Gene Symbol: FLNA
  Gene Name: filamin A, alpha
  ENST ID: ENST00000610817
  CDS Start-End: 331-7278
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatcgctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccatt

SEQ ID NO: 134599 - DNA, 9463 bp, Homo sapiens
  Payload ID: 6298
  Gene Symbol: FLNB
  Gene Name: filamin B, beta
  Uniprot ID: O75369
  ENST ID: ENST00000295956
  CDS Start-End: 166-7974
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 134600 - DNA, 9391 bp, Homo sapiens
  Payload ID: 6298
  Gene Symbol: FLNB
  Gene Name: filamin B, beta
  Uniprot ID: O75369
  ENST ID: ENST00000358537
  CDS Start-End: 166-7902
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 134601 - DNA, 2002 bp, Homo sapiens
  Payload ID: 6298
  Gene Symbol: FLNB
  Gene Name: filamin B, beta
  ENST ID: ENST00000419752
  CDS Start-End: 107-694
ctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtgggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgg

SEQ ID NO: 134602 - DNA, 9430 bp, Homo sapiens
  Payload ID: 6298
  Gene Symbol: FLNB
  Gene Name: filamin B, beta
  Uniprot ID: O75369
  ENST ID: ENST00000429972
  CDS Start-End: 166-7941
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaa

SEQ ID NO: 134603 - DNA, 7402 bp, Homo sapiens
  Payload ID: 6298
  Gene Symbol: FLNB
  Gene Name: filamin B, beta
  ENST ID: ENST00000493452
  CDS Start-End: 158-7387
atttttgaatcacacaggatgctattctagactttttagatatatccaggaatagagtaaaaaataaaatccctcctgcataaaggcaccaggctttttccaagctttgtttattttttaacaccacttcttcaaggaatggataatccccatcttcatgcaagaacatagcacccggaggagaagtctcagtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaa

SEQ ID NO: 134604 - DNA, 315 bp, Homo sapiens
  Payload ID: 6298
  Gene Symbol: FLNB
  Gene Name: filamin B, beta
  ENST ID: ENST00000470231
  CDS Start-End: 1-219
ttcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccaggggtcagagtcatgaactgctctgcccagatcctgtggggctggagggtgcagtttcatactggctctaggtgatggcagtgctccgtgccccgcatgcggccgcctggcctcaccacggcagtgcaggcacagtcgttggcatgacaaatcaacagcagtgatatgtcg

SEQ ID NO: 134605 - DNA, 404 bp, Homo sapiens
  Payload ID: 6298
  Gene Symbol: FLNB
  Gene Name: filamin B, beta
  ENST ID: ENST00000466455
  CDS Start-End: 1-404
cttggcggtggaaggccccagcaaagtggacatccagacggaggacctggaagatggcacctgcaaagtctcctacttccctaccgtgcctggggtttatatcgtctccaccaaattcgctgacgagcacgtgcctgaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccag

SEQ ID NO: 134606 - DNA, 8079 bp, Homo sapiens
  Payload ID: 6298
  Gene Symbol: FLNB
  Gene Name: filamin B, beta
  Uniprot ID: O75369
  ENST ID: ENST00000490882
  CDS Start-End: 166-8067
gcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagtgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgagctgacgacacggattcccagtcatggcgcagccccttgaaagccctttcagagttctttaaaggtgacccgaagggtgactttaataagacaggcttggtggagccagtgaacgtggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagcgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctc

SEQ ID NO: 134607 - DNA, 1530 bp, Homo sapiens
  Payload ID: 6299
  Gene Symbol: FBLIM1
  Gene Name: filamin binding LIM protein 1
  Uniprot ID: Q8WUP2
  ENST ID: ENST00000332305
  CDS Start-End: 32-862
tctgtccctagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtct

SEQ ID NO: 134608 - DNA, 3695 bp, Homo sapiens
  Payload ID: 6299
  Gene Symbol: FBLIM1
  Gene Name: filamin binding LIM protein 1
  Uniprot ID: Q8WUP2
  ENST ID: ENST00000375766
  CDS Start-End: 641-1762
atgaagaacgcgaggggatgggcagcggggagggaaggaaacccaccccgactccccattctcctacccccactccccatccctcccattcccccatcgcccccatccccattcccccccattcccaccccctggcctgtgccaagggggaggggaggcgtcgtccagggaacaaagggagggggaaggggcggcgcggggcgcggccgggcaggttggggggcaggtaggggccgcttccgcggggcgggaatcccgcgccccctccccccgagcctcaccttttatggtaaagcggcgcggggcggcggggcggagggagccgagggggcggggagggcggacgggcggaggggacgggaggcccagcggctccgggctccgctggctcgggcgtcggatcggagccgccggggcgcgggcggcccagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctcttcca

SEQ ID NO: 134609 - DNA, 3498 bp, Homo sapiens
  Payload ID: 6299
  Gene Symbol: FBLIM1
  Gene Name: filamin binding LIM protein 1
  Uniprot ID: Q8WUP2
  ENST ID: ENST00000375771
  CDS Start-End: 444-1565
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctcttcca

SEQ ID NO: 134610 - DNA, 507 bp, Homo sapiens
  Payload ID: 6299
  Gene Symbol: FBLIM1
  Gene Name: filamin binding LIM protein 1
  ENST ID: ENST00000430076
  CDS Start-End: 456-507
gacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaaagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctgg

SEQ ID NO: 134611 - DNA, 577 bp, Homo sapiens
  Payload ID: 6299
  Gene Symbol: FBLIM1
  Gene Name: filamin binding LIM protein 1
  ENST ID: ENST00000431771
  CDS Start-End: 266-577
gctccgctggctcgggcgtcggatcggagccgccggggcgcgggcggcccagcagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctc

SEQ ID NO: 134612 - DNA, 1543 bp, Homo sapiens
  Payload ID: 6299
  Gene Symbol: FBLIM1
  Gene Name: filamin binding LIM protein 1
  Uniprot ID: Q8WUP2
  ENST ID: ENST00000441801
  CDS Start-End: 208-1332
tggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggtacgagaagggtttgtgcactgggtggggtgcagggacagggcgagacccaagcagggtgaaggagctgagcttgagtcctgggtgctgggccagagtttcctgtctactggtttattataaagaatattacagggctgggctgggcgcggtggctcacgcctgtaatcccagcactttgggaggccgaggcgggtggatcacgaggtcaggagatcgagatcatcctggctaacatggtgaaaccccgtctctactaaaaatacaaaaaaaattagccaggcatggtggcgggcgcctgtagtcccagctactcgggaggctgaggcaggagaatggcgtgaacctgggaggcagagcttgcagtgagccgagatcacgccactgcactccagcctgggcaacagagtgtgagactccgtctcaaaaaaaaaaaaaaaaaaaaa

SEQ ID NO: 134613 - DNA, 511 bp, Homo sapiens
  Payload ID: 6299
  Gene Symbol: FBLIM1
  Gene Name: filamin binding LIM protein 1
  ENST ID: ENST00000510929
  CDS Start-End: 468-511
cagccgggccctgccttccagagctcctggagcggcctgtcccccgggacaccgggacccacctgcagagggcttaccgctcaggagagcagaacaaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttat

SEQ ID NO: 134614 - DNA, 576 bp, Homo sapiens
  Payload ID: 6299
  Gene Symbol: FBLIM1
  Gene Name: filamin binding LIM protein 1
  ENST ID: ENST00000510393
  CDS Start-End: 343-576
atcgacacccgagctgctgcgggccaggacgaatccctccatccgggagcagtggtggcggtggaacaggtggcctggggtgctggaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatg

SEQ ID NO: 134615 - DNA, 582 bp, Homo sapiens
  Payload ID: 6299
  Gene Symbol: FBLIM1
  Gene Name: filamin binding LIM protein 1
  ENST ID: ENST00000502638
  CDS Start-End: 490-582
agccgggccctgccttccagagctcctggagcggcctgtcccccgggacaccgggacccacctgcagagggcttaccgctcaggagagcagaacaaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgagg

SEQ ID NO: 134616 - DNA, 611 bp, Homo sapiens
  Payload ID: 6299
  Gene Symbol: FBLIM1
  Gene Name: filamin binding LIM protein 1
  ENST ID: ENST00000496928
  CDS Start-End: 522-611
gttgcaggaagtttggcacctgccgatcggtgacatcgacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggcagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtg

SEQ ID NO: 134617 - DNA, 611 bp, Homo sapiens
  Payload ID: 6299
  Gene Symbol: FBLIM1
  Gene Name: filamin binding LIM protein 1
  ENST ID: ENST00000508310
  CDS Start-End: 509-611
gtttggcacctgccgatcggtgacatcgacacccgagctgctgcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaagtaagcgctcacctccgccggacaggagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagttt

SEQ ID NO: 134618 - DNA, 562 bp, Homo sapiens
  Payload ID: 6299
  Gene Symbol: FBLIM1
  Gene Name: filamin binding LIM protein 1
  ENST ID: ENST00000502739
  CDS Start-End: 129-562
ccgggctccgctggctcgggcgtcggatcggagccgccggggcgcgggcggcccagagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagag

SEQ ID NO: 134619 - DNA, 571 bp, Homo sapiens
  Payload ID: 6299
  Gene Symbol: FBLIM1
  Gene Name: filamin binding LIM protein 1
  ENST ID: ENST00000483633
  CDS Start-End: 138-571
ccagcggctccgggctccgctggctcgggcgtcggatcggagccgccggggcgcgggcggcccagagctggcctgaacctccaggacttcagcccttctaggagaatctgatcccagccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccacc

SEQ ID NO: 134620 - DNA, 9188 bp, Homo sapiens
  Payload ID: 6300
  Gene Symbol: FLNC
  Gene Name: filamin C, gamma
  Uniprot ID: Q14315
  ENST ID: ENST00000325888
  CDS Start-End: 262-8439
ttcttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 134621 - DNA, 9042 bp, Homo sapiens
  Payload ID: 6300
  Gene Symbol: FLNC
  Gene Name: filamin C, gamma
  Uniprot ID: Q14315
  ENST ID: ENST00000346177
  CDS Start-End: 213-8291
cggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggattgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcaga

SEQ ID NO: 134622 - DNA, 1938 bp, Homo sapiens
  Payload ID: 6301
  Gene Symbol: FIBIN
  Gene Name: fin bud initiation factor homolog (zebrafish)
  Uniprot ID: Q8TAL6
  ENST ID: ENST00000318627
  CDS Start-End: 344-979
tcccgggagcaaggggaaactccgagaggagggcaacagagccagcatcttgccagggccccggaggaggggttccccgctacgcctgtgccggaggagttccagtcaccgagcgaggggcgcaagggtgggtgcatcctgcgctgcggcgggcgcgctacccagacgctggtgtgcagagccacatgaagcctgctggggactgggggccagggagcagcaagccagctgggactgaggcggacgctgtctcagggagacgctgactcgcaaagacactcccttccttgtgcctgggtaaaaagtctcctcctggggtccctggccatcctgaatatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggagggtgggggacagaagatggggctacatttcccccatacctactatttttttatatcccgatttgcactttgagaatacatctaaggtcatctttcaaaagagaaaaattggacacttgagtgactttgtttttagttttgtttttgtacattatttatgtgattgttatggaattgtcacctggaaagaacaattttaagcaatgtcatttctagatgggtttctaattctgcagagacacccgtttcagccacatctaaaagagcacagtttatgtggtgcggaattaaacttccccatcctgcagattatgtggaaatacccaaagataatagtgcatagctcctttcagcctctagccttcactcctgggctccaaaagctatcccagttgcctgtttttcaaatgaggttcaaggtgctgctttgcatgcctgccaacccatggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttcaagtagggggaatcctaattctaataactccttagctaagttttattattcaggcaataaacatgttttcatgtaa

SEQ ID NO: 134623 - DNA, 461 bp, Homo sapiens
  Payload ID: 6302
  Gene Symbol: FAU
  Gene Name: Finkel-Biskis-Reilly murine sarcoma virus (FBR-MuSV) ubiquitously expressed
  ENST ID: ENST00000279259
  CDS Start-End: 73-336
gacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttag

SEQ ID NO: 134624 - DNA, 533 bp, Homo sapiens
  Payload ID: 6302
  Gene Symbol: FAU
  Gene Name: Finkel-Biskis-Reilly murine sarcoma virus (FBR-MuSV) ubiquitously expressed
  ENST ID: ENST00000434372
  CDS Start-End: 97-324
gacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagat

SEQ ID NO: 134625 - DNA, 697 bp, Homo sapiens
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENST ID: ENST00000531743
  CDS Start-End: 245-646
cttgtagcaggttggctgcggggtcagaaggcgcggggggaaccgaagaacggggcctgctccgtggccctgctccagtccctatccgaactccttgggaggcctggccttccccacgtgagccgccgcgaccaccatcccgtcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtca

SEQ ID NO: 134626 - DNA, 507 bp, Homo sapiens
  Payload ID: 6302
  Gene Symbol: FAU
  Gene Name: Finkel-Biskis-Reilly murine sarcoma virus (FBR-MuSV) ubiquitously expressed
  ENST ID: ENST00000526555
  CDS Start-End: 182-507
gcggtagctgggaccgccgttcaggtaagaatggggccttggctggatccgaagggcttgtagcaggttggctgcggggtcagaaggcgcggggggaaccgaagaacggggcctgctccgtggccctgctccagtccctatccgaactccttgggaggcctggccttccccactcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcg

SEQ ID NO: 134627 - DNA, 538 bp, Homo sapiens
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENST ID: ENST00000527548
  CDS Start-End: 87-488
gcggtagctgggaccgccgttcaggtaagaatggggccttggctggatccgaagggcttgtagcaggttggctgcgggtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 134628 - DNA, 1125 bp, Homo sapiens
  Payload ID: 6302
  Gene Symbol: FAU
  Gene Name: Finkel-Biskis-Reilly murine sarcoma virus (FBR-MuSV) ubiquitously expressed
  ENST ID: ENST00000529259
  CDS Start-End: 103-330
tcgcgatcgtttctggaccgctttccactcccaaatctcctttatcccagagcatttcttggcttctcttacaagccgtcttttctttactcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtgagtgagagaggaatgttctttgaagtaccggtaagcgtctagtgagtgtggggtgcatagtcctgacagctgagtgtcacacctatggtaatagagtacttctcactgtcttcagttcagagtgattcttcctgtttacatccctcatgttgaacacagacgtccatgggagactgagccagagtgtagttgtatttcagtcacatcacgagatcctagtctggttatcagcttccacactaaaattaggtcagaccagggcccccaaagtgctctataaaattagaagctggaagatcctgaaatgaaacttaagatttcaaggtcaaatatctgcaactttgttctcattacctattgggcgcagcttctctttaaaggcttgaattgagaaaagaggggttctgctgggtggcaccttcttgctcttacctgctggtgccttcctttcccactacaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccaaacaggagaagaagaagaagaagacaggtcgggctaagcggcggatgcagtacaaccggcgctttgtcaacgttgtgcccacctttggcaagaagaagggccc

SEQ ID NO: 134629 - DNA, 847 bp, Homo sapiens
  Payload ID: 6302
  Gene Symbol: FAU
  Gene Name: Finkel-Biskis-Reilly murine sarcoma virus (FBR-MuSV) ubiquitously expressed
  Uniprot ID: P62861
  ENST ID: ENST00000529639
  CDS Start-End: 393-794
gagcctcacacccacgcgatgccctcagctcctcgctcagcgctctcaccaacagccgtagcccgcagccccgctggacaccggttctccatccccgcagcgtagcccggaacatggtagctgccatctttacctgctacgccagccttctgtgcgcgcaactgtctggtcccgccccgtcctgcgcgagctgcctgcccaggcaggttcgccggtgcgagcgtaaaggggcggagctaggactgccttgggcggtacaaatagcagggaaccgcgcggtcgctcagcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcatc

SEQ ID NO: 134630 - DNA, 355 bp, Homo sapiens
  Payload ID: 6302
  Gene Symbol: FAU
  Gene Name: Finkel-Biskis-Reilly murine sarcoma virus (FBR-MuSV) ubiquitously expressed
  ENST ID: ENST00000525297
  CDS Start-End: 9-305
tcgccaatatgcagctctttgtccgcgcccaggagctacacaccttcgaggtgaccggccaggaaacggtcgcccagatcaaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtc

SEQ ID NO: 134631 - DNA, 734 bp, Homo sapiens
  Payload ID: 6303
  Gene Symbol: FIS1
  Gene Name: fission, mitochondrial 1
  Uniprot ID: Q9Y3D6
  ENST ID: ENST00000223136
  CDS Start-End: 82-540
agtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 134632 - DNA, 631 bp, Homo sapiens
  Payload ID: 6303
  Gene Symbol: FIS1
  Gene Name: fission, mitochondrial 1
  ENST ID: ENST00000442303
  CDS Start-End: 45-317
gtggcacagtagactgtagtgtgaggctcgcgggggcagtggccatggaggccgtgctgaacgagctggtgtctgtggaggacctgctggtgaggcctggcccggacagagggaaagggaaggtcggagggcgggtcctgaggagagtcagagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaccccc

SEQ ID NO: 134633 - DNA, 745 bp, Homo sapiens
  Payload ID: 6303
  Gene Symbol: FIS1
  Gene Name: fission, mitochondrial 1
  ENST ID: ENST00000449367
  CDS Start-End: 72-212
cgcccctgccactgggccatggagactgtggcacagtagactgtagtgtgaggctcgcgggggcagtggccatggaggccgtgctgaacgagctggtgtctgtggaggacctgctgagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaacccccgtgtctgcgttgaggggaggggtgggttctgaacgctgggcacagggggcggagacgtcactcctggtcctctcctgcccctgccctccaggttggcacggggttctttgtccaccccgcagcccagagcccacacccttccttcctcc

SEQ ID NO: 134634 - DNA, 692 bp, Homo sapiens
  Payload ID: 6303
  Gene Symbol: FIS1
  Gene Name: fission, mitochondrial 1
  ENST ID: ENST00000435848
  CDS Start-End: 226-692
tccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagcccca

SEQ ID NO: 134635 - DNA, 915 bp, Homo sapiens
  Payload ID: 6303
  Gene Symbol: FIS1
  Gene Name: fission, mitochondrial 1
  ENST ID: ENST00000474120
  CDS Start-End: 409-588
aacgaaaccgacacccggaagcctagtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaacccccgtgtctgcgttga

SEQ ID NO: 134636 - DNA, 1005 bp, Homo sapiens
  Payload ID: 6303
  Gene Symbol: FIS1
  Gene Name: fission, mitochondrial 1
  ENST ID: ENST00000473527
  CDS Start-End: 384-626
gtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 134637 - DNA, 1215 bp, Homo sapiens
  Payload ID: 6304
  Gene Symbol: FZR1
  Gene Name: fizzy/cell division cycle 20 related 1
  Uniprot ID: Q9UM11
  ENST ID: ENST00000313639
  CDS Start-End: 1-1215
atggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaa

SEQ ID NO: 134638 - DNA, 1491 bp, Homo sapiens
  Payload ID: 6304
  Gene Symbol: FZR1
  Gene Name: fizzy/cell division cycle 20 related 1
  Uniprot ID: Q9UM11
  ENST ID: ENST00000395095
  CDS Start-End: 1-1491
atggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggtaaagtgggagtctgtgtctgtgctcaacctcttcaccaggatccggtaa

SEQ ID NO: 134639 - DNA, 5212 bp, Homo sapiens
  Payload ID: 6304
  Gene Symbol: FZR1
  Gene Name: fizzy/cell division cycle 20 related 1
  Uniprot ID: Q9UM11
  ENST ID: ENST00000441788
  CDS Start-End: 237-1718
ggccgggcgcgcgcggcggagggagggagccgggaggcagcggaggagcgaccgccgccatattagggaccgcggagcccgggatcccgtcagcggcggccgcggccgggcctgcgggagctgcggaggccggaggcgggcgctgtgcggtgccaggagaggcggggtcggcgggagccagcgagccacgggagcgagccaggctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagtccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctacgccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttaca

SEQ ID NO: 134640 - DNA, 1331 bp, Homo sapiens
  Payload ID: 6304
  Gene Symbol: FZR1
  Gene Name: fizzy/cell division cycle 20 related 1
  ENST ID: ENST00000591290
  CDS Start-End: 7-1092
ctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacgtattcccttagcaccaagcgctccagccccgatgacggcaacgatgtgtctccctactccctgtctcccgtcagcaacaagagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacc

SEQ ID NO: 134641 - DNA, 2662 bp, Homo sapiens
  Payload ID: 6305
  Gene Symbol: FKBP10
  Gene Name: FK506 binding protein 10, 65 kDa
  Uniprot ID: Q96AY3
  ENST ID: ENST00000321562
  CDS Start-End: 105-1853
agaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaatggc

SEQ ID NO: 134642 - DNA, 398 bp, Homo sapiens
  Payload ID: 6305
  Gene Symbol: FKBP10
  Gene Name: FK506 binding protein 10, 65 kDa
  ENST ID: ENST00000429461
  CDS Start-End: 156-398
gtagtgcctccctcagactctaacacactcagcctggccccctcctcctattgcaaccccctcccccgctcctcccggccaggccagctcagtcttcccagcccccattccacgtggaccagccagggcggggggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctac

SEQ ID NO: 134643 - DNA, 1965 bp, Homo sapiens
  Payload ID: 6305
  Gene Symbol: FKBP10
  Gene Name: FK506 binding protein 10, 65 kDa
  ENST ID: ENST00000455106
  CDS Start-End: 1-1160
tgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactgactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaa

SEQ ID NO: 134644 - DNA, 563 bp, Homo sapiens
  Payload ID: 6305
  Gene Symbol: FKBP10
  Gene Name: FK506 binding protein 10, 65 kDa
  ENST ID: ENST00000585922
  CDS Start-End: 51-563
agagttctcatctttcccgagcctctctccctggccaggccccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtc

SEQ ID NO: 134645 - DNA, 2826 bp, Homo sapiens
  Payload ID: 6305
  Gene Symbol: FKBP10
  Gene Name: FK506 binding protein 10, 65 kDa
  ENST ID: ENST00000489591
  CDS Start-End: 47-490
actccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggtaggggcgttccccagccaccacctcagctcctcctccgaactgcccattgtgtctaggccaccccctcccacagtgggattccaggcaccgctcggcccctctcatcacaaaaacatgcatgcagcttacatctggtcaccccatctgattcctgccacacagactccatcggtttcctccagggcagcgccccacttcgccccttccgcagtggagaagggcagccaagtttggggagggagggtggttatggaaaaacagaaccagcatacccccaggacccagctgtgctgggagcctcagtgtcctcacctgtcaagtgggcaagccatgctgatccgcagggtaagttactgggagtttgcaagacggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 134646 - DNA, 598 bp, Homo sapiens
  Payload ID: 6305
  Gene Symbol: FKBP10
  Gene Name: FK506 binding protein 10, 65 kDa
  ENST ID: ENST00000585664
  CDS Start-End: 83-598
ctttggtgtccactcagagttctcatctttcccgagcctctctccctggccaggccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccct

SEQ ID NO: 134647 - DNA, 725 bp, Homo sapiens
  Payload ID: 6306
  Gene Symbol: FKBP11
  Gene Name: FK506 binding protein 11, 19 kDa
  ENST ID: ENST00000256680
  CDS Start-End: 58-336
ctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggggcgagaacgggatctttggaagagcatccgtgacccctgtagtccgatcgtaggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataa

SEQ ID NO: 134648 - DNA, 959 bp, Homo sapiens
  Payload ID: 6306
  Gene Symbol: FKBP11
  Gene Name: FK506 binding protein 11, 19 kDa
  Uniprot ID: Q9NYL4
  ENST ID: ENST00000453172
  CDS Start-End: 93-533
agtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagggactaaagacaacctgatgaggccacctggcatgacctccagcagccagtaacttgttagggaagagacctgcttgggccacatgggtctgctgcctgtgccaccacctttcccagaacactggacttctttcctgcccttttctacaactctacgctgtgtcagctgtacagccaccccccaccccttcctttcagcctccatcagggaagagacagtaaaaataatcacagtcaagtgattcaaaacaaaacaaaaagcaactgttaaagccaagtctgccccataactttaaaagccatcattggtcactgccgatgtctatttttgaagggttgagatggacagatttcccaagatgcatatcttttgctttcagttctaacaaatgttctattagctaaaatgtgttgtactccacagagtattgggctcgtaattctttttttttttttgagatggagtttcactcttgttg

SEQ ID NO: 134649 - DNA, 630 bp, Homo sapiens
  Payload ID: 6306
  Gene Symbol: FKBP11
  Gene Name: FK506 binding protein 11, 19 kDa
  ENST ID: ENST00000444214
  CDS Start-End: 306-605
cgtggcaagcggttcgggagaagaaactcggggctctggggtcgtcgagcacgtggcgaggggagagacgttgctcttccgtgcctcttttccctccttgcttttctgccagttcctacctggcacggagaagtgcagggtggagagatctccgagaagcgccagccttctggggcttcctgttccttacagcgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 134650 - DNA, 524 bp, Homo sapiens
  Payload ID: 6306
  Gene Symbol: FKBP11
  Gene Name: FK506 binding protein 11, 19 kDa
  ENST ID: ENST00000546847
  CDS Start-End: 1-192
tccctgaccagagaccctctggttatagaacttggccaaaagcaggtgattccaggtctggagcagagtcttctcgacatgtgtgtggggtggaaaaattcgtgttttgggtgtgaagattcagggggttttgctgaaggagcttcagctggactgaggctgctggcctacctctcctgcctctggctgtgactgacattccttccctcagagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactt

SEQ ID NO: 134651 - DNA, 1052 bp, Homo sapiens
  Payload ID: 6306
  Gene Symbol: FKBP11
  Gene Name: FK506 binding protein 11, 19 kDa
  ENST ID: ENST00000552878
  CDS Start-End: 84-632
tgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagatggagtttcactcttgttgcccaggctggagtgcaatagtgcaatcttcactcaccacaacctccgccacccgggttcaagcaattctcctgtctcagcctcccgagtagctgggattacaggcatgcgccaccacgaccggctaattttatacttttagtagagatggggcttctccatgttggccaggctggtctcaaactcccaacctcaggtgatccgcctgccttggcttcccaaagtgcggggattacaggcatgagccaccgcgcctggctgggctcgttaattcttatcctagttccagcttagaggaaggcctggaaggagggtagggggaccaaggagaaacttttacccaaagccctattacctccccattcccagtgctgcttatttgtacctcttctgcccactcatttctgttccacctgcccctttacttcttaagcagcatcctcatccttcttcctcttcagctcttatgttgaaactcctgttatctcataatcacgttgaatgtgctcattggttggttgattttttaaagtctagtttaaatccatttaatttcagccct

SEQ ID NO: 134652 - DNA, 482 bp, Homo sapiens
  Payload ID: 6306
  Gene Symbol: FKBP11
  Gene Name: FK506 binding protein 11, 19 kDa
  ENST ID: ENST00000547789
  CDS Start-End: 65-283
gtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctgtccgatcgtaggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccaggtaatctgactaggactct

SEQ ID NO: 134653 - DNA, 1030 bp, Homo sapiens
  Payload ID: 6306
  Gene Symbol: FKBP11
  Gene Name: FK506 binding protein 11, 19 kDa
  Uniprot ID: Q9NYL4
  ENST ID: ENST00000550765
  CDS Start-End: 400-1005
ggcacatcctgagcaccctgtgccttatctgtaaaatggaaacaatcatgccgacctttcagggtggttttgaggattagagactagctcctgacacacagtaggtaatcgtaaatgggtgctattgtttggcccgacccacgttataggacagaacgtctaacggatgcgtcagaacctgcgccctccggatcttggagggtacagagggcgcccctcggcctcctccctttcggaggtggggacaaggtggaggaagggctgcaggaggaggagctctagcatcgcgacccgccccgtcccgtccagtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaactta

SEQ ID NO: 134654 - DNA, 4960 bp, Homo sapiens
  Payload ID: 6307
  Gene Symbol: FKBP14
  Gene Name: FK506 binding protein 14, 22 kDa
  Uniprot ID: Q9NWM8
  ENST ID: ENST00000222803
  CDS Start-End: 177-812
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctcaaaaaaaaaaaaagaagcagacctacagcagctactattgaataaatacctatcctggattttaaaaaagaaaaaaatatatataattttattttaaattggcttttatctttaattcttttttttaaagttatcaaatcttcattttctaagagtagccctttatagtgtacaaaatgatattaagtgcattattatcttcgcttttcatggctctgagtcataaaacaagctggtggatctcactgtacctaatttatagacgaggaaattgtcattcaaaaagattgactgttatgcccagggtcagcactaacctgcagaaccagtattcagtccccaagttcagtgtcttctactgccctctactaatgaaaagtgaaaatttccctggggtctaattctctcttcagtttgctgtgccgttgtttatctttgagtcttcattctctgaagatggctttctgcctgtttctggtacattagaattctcactatgatatagaaatggcttcagtttcatagcataatcttgcagttagctctgaattgcctcaaaaaccctgaacaacgcgaggttccagatgtgttttacttctttcattcatatttacccccatttgttgtttaaaaagaattatgaacaattattacatcatatgtagaccactttcactgattatatgttgacattttcctcagtaaaacataaagttcttaacaagactatactgtaacacctttctccaacaaaatcagctgtatgttgaaaactattaagtcattgctaatgttttaagccataatacagacagccttatactctatgatgggagaagggaaagtagtttgtccgatggtgctactctgtataaacattactgatgctatctatagtagggcaagaaaagtaaaaagagttttgattattcaggcagcatttttaaaaacctgtgaatttgtatcagttctcatctaaacatttggacacaagtataaaatgaaaacatatgcacaagttatggtttttaagttatctgctcttttttttggtttcactgtacctttgtactcttctattagtgggaataatcagacatgaactgtgacttcacatgtacagtcatacctcacttaatgatggagatgcactctgagaaatgtctaattaggttatttcatcgttgtgggaacatcatagagtgtacttacacaaacctagatagtgtagcctgctacacatgtaggacatgtatatagcctattgctcctaggctacagcatgttgctgttctgaatcatgtaggcaattgtaacacaatggcaagtgtctgtttattcaaacatctaaacacagaaaagatactacaacaataacaatatggtataaaagattttgtaaaaaatctggtcaggtgcagtggttcacgcctgtaatcctagcactttgggaggctgcctcagcaggtggattgcttgagcccagaagctcaagaccagcctgggcaacatggcgaaaccccgtctctgctaaaagtacaaaagctgaggttggaggatcacctgagcctggcaaggtcaaggctgcagtgagccatgatcataccactgcactccagcctgggtgacagagtgactccccatctaaaaaaaaaaatatatatatatatatatactatatatatatatataccatatatatggtatatatatatatagtatatatatatatggtgtgtgtatatatatatatatggtatacctgtatagggcacttactaacggagcttacagaactggaagttgctctggatgagtcagtggtgagtgaatgtaaaggcctaggacattactgtacactactgtagactttataaacaccgtacacttaggtgacactaaaatttataaaaaatgtttttcttctggttgggcatggtgccttatgcctataatcccagcattatgggaggccaaggtgggtggatcactcgaggtcatgagtttgggaccagccgggccaacatggctaaaccccatctctactaaaaatacgataattagccaggtgtggtggcacatgcgtgtagtcccagctaattgagaggctgaggcaggagaattgcttgaatccaggaggtggaggttgcagtgagccaagatcgaaccactgcactctagtctgggtgacagaggagcaagactctgtctcaaaaaaaaaaattctataatttttatagaaataataaaaaactaaccttagcttactgtaaattttctagtttagaaacttatttaaaaacaatttttggactcttctagtaataacgtagcttaaaacacacattgcatagctgtacaaaaatattttccttatatccttattatataagcttttatctatttaaattttgaatttttaaactttttggtcaaaaaccaagacaaacacactagcctaggcctatgcagggtcaggatcaagacatccctagcaggtgacaggaatttttcaactccattataatctgtggggccaccatcatatatatattgtacattgaccgaaacatggttacatgactatataatttgcgtcaatactgctcagtgtgccatatttaaatttacatgactatattgtgatattcttttcaaaataaagtttatttgggagataa

SEQ ID NO: 134655 - DNA, 703 bp, Homo sapiens
  Payload ID: 6307
  Gene Symbol: FKBP14
  Gene Name: FK506 binding protein 14, 22 kDa
  ENST ID: ENST00000412494
  CDS Start-End: 1-268
agttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaagtcttttagtacatgcttgcatgcctcttttggaaagataccagttttatcaacaacctagcgcatgtcacatctctgtctagatctgaaatggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaac

SEQ ID NO: 134656 - DNA, 1085 bp, Homo sapiens
  Payload ID: 6307
  Gene Symbol: FKBP14
  Gene Name: FK506 binding protein 14, 22 kDa
  ENST ID: ENST00000419018
  CDS Start-End: 155-355
gagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccacgtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagt

SEQ ID NO: 134657 - DNA, 4336 bp, Homo sapiens
  Payload ID: 6308
  Gene Symbol: FKBP15
  Gene Name: FK506 binding protein 15, 133kDa
  Uniprot ID: Q5T1M5
  ENST ID: ENST00000238256
  CDS Start-End: 119-3778
agttcgccctgccggaaagcagcacgccgccgcggcattttacgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttg

SEQ ID NO: 134658 - DNA, 2815 bp, Homo sapiens
  Payload ID: 6308
  Gene Symbol: FKBP15
  Gene Name: FK506 binding protein 15, 133kDa
  ENST ID: ENST00000414250
  CDS Start-End: 1-1494
gacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcaggtaacattttataaccgtattaattatatcctataatttgctgtggttctagtcagtctcttttcttcttcctgtacatttcatacagtagcagttccccaaagtcagagtttgtaatttttttcccttccttggttaccactttctcatctctaaaccaggcaaaggataacctacgttccagtgtcataaagattaaatgcaagaacaagtagagcccctagtacaacgtagtaaagatgcaatcaatgtttgtttccttttcttttcacacatatccagttgaagcgtgtatattcgcgttcttctgtattcttttctactaaaagttggcaggctaacattctgcagtatattcagcagaatggtatggtttaaaagtggaaccatgtggaaaatgtagcttgactctgctatctagtaaacttttcttaaagaaggcctttttcctgttatcacagaaaacaatggcagcagcctgtttgccaggggtagcagaccctttcttctgcctcaacacacttggtggataaggcatactgtcactgggaacagctgctcactccttgtgatgcttaatggaggtgtgggaatgatggtggataggctatgcctcattaacatggggagtctcgaaactggaaaaagtcccactgttgccctctttctccccatccctcctctcctccatggagaattactatgctgtagactaagaattttttttaagtggatgcgtagttatatctatccctggaaatgagctagacttccttatttcaaggaagaattaccatcctcattaaaataaaagctgctgtttattaagcgcttactatctgtcaggcctgtaacttactagcttttcagaactttacctatctcacttcatttagtccacagaacagccctatgaagtgatattattatcttcctcttacagttgaggtgaccgagactcaaaggaacatgagagctcttggtctcgtggattagcttcagaatctagcaggggagaggcatccttggaaattggcagatttggtttggaatctcagtgagcacttcttctttaaactcaatggaagctaagcagagtttattaatctaaaaacttcttagacaataggcctgataatggggaatgaatccctgcttaattatctcaccagatgactgggtagtgacctaagatacactttcttcagtttctgggtaggattttagtgactggtttcccctgggatacatagataactctcctgctgcagtccttaccaactgccaaacccagatctcacccatctctagcttcagtaagtttgagtctcctcccagctcatccactttattccac

SEQ ID NO: 134659 - DNA, 8807 bp, Homo sapiens
  Payload ID: 6308
  Gene Symbol: FKBP15
  Gene Name: FK506 binding protein 15, 133kDa
  ENST ID: ENST00000446284
  CDS Start-End: 1-3735
gacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgacccaagcccttggagaaaaattgagtttggttccaagggctgtctgtgctcttttgggaatctaagggtaggagtcttacagatctgggtcagttaatgtgcacaaaacgttgtggcatatttactccctttgatacctaaccctggaacttttaggctttcaaagaaagtcaccactgtagtcctagctcatccctggggcatgatggttctgtgaggaccagtccagtcatcctcttgctcctgcaggcttagtcctgcagtctaggaagccatgcaaagaaggtgagagggtcccttctttccattgttcatggcacctgagggattcttcactttgagagcagcttccattcccttagaactcatgggaccaggacttatgcagagaacagtagtgagaaaatacttgtggtcattttcttgattccaggatcttccaaagattatgcaatcagtctttaaaaaaacagaataattaattttaataaaaaatgtttcttgattttaaatgttttaaaagataggacccaaaattccacttcatctggcctggcatcatccttgcaggctttggatatgtctcccgtgtgcggacctgggaggcagtgagaactaattatttctttgttgcttaacaaaaggcggtgctgtttggcactttcacagactggcttatctccagcaaccactgcagaagacagtgttatcaccattttatagaggagaaaactgagacttagagaggtaaagtaatttgcccaaagttacatatctaggaagcctcagcacaagaattcaaatcctggccatctgattccagagcctgggctcttggccagcacagcctgactgtcactggttgggggaaggggcggtgatgcttttagaaacaggcttcttgagacaccaggcagctttccagttccctgcaaacatgggggaatgccctgatcagtcctaaaggtgtgacatagtctactttctagggcagttatttcttattgtaaattaactagtggctattatatttgcttctgcccgcagggagagaagatgctgagtaattgtgccaacacaggtgcttaaagtccgtgtgacagttacttttcttatagcatgtactcaattaatacttgttacatgaatgaagaatgacttgacttgcctcagttggcattctggggtgtctacctgggtgcagcatttcagggctgggtttccctgagcagagttgtctttgtagcagatggatggactctgtcctcagacaggcttataaagagtactaccagttctattagccccactcagcccctgcagttgttacaagggttcatgtgctttctgttggaattaggagaacagaacagtcatagactatttaaaaatatatatttactaaaatgtatttgtttgtttttaattcccaaagcttacaaccatcttttcatctaatctgtgaggtatttagtatacagcagtgattttctctctttccttttttataaagtgaagaggttcaactatccagagagtcccatctaactcaaaaaatgtaatggctttggttggattgcatcttcagtcagtacctgcccatggcttaatcagtattttaagtgaatgaatcatgtttccccactagatcattacgagtaagcagtaagtaataaatagagaatattaagtattgaacattattagatgcagctttttgttctgcatagaagaaagatgaggataaaggagggcattgaggccacgaagagcttcccagacacccacggccatcagatcatcttcttcctgcaggcagtgccttctggtggaaggagctcagtctatcagagaataaaccaggagcctgaaagcagtcctgtgtctctgcctttaatcagctgtcacttattctctccccaagaaagggaaataggtctcagcagtttctgccatccatcatgaatcaatgaaatcatttcattaaaaatttttttgtatgaatgtgcaaaattgccaactaggagttcaatgggaaaaataaaaaaaacttagtttgtcaacatgatccatagacgagatgatcttcatgtgttccaaaggcagaaaggtgagaaaaaggatctagcttggtctctgtccctcaaagacagaagaggtcaggaagtccaatgggcgatgctcctgtagataaggcacaaagcaggagagctgagggtgtccaggttccatgccctgcatcaccaagaacccttctccctggcttgaaatctttggaaattcctggtttgagtcacagagaagcattgtcatgggctcagtaaccctgccacccctgttatctccattctccctttggtcacagcagctgtcttaagacacaagaccatgcctgggccctacgtaggctggctgagaaggaaggttgctgcaatggcttccgaactccagggagcaagtgctggcttcagctcaaagtttccaggggctgggaataaggtggaggaatagccatcagaagaaagggcagttggaagtatagtgtctggaagagggggctccatgtccctccagcctcagtgcctgcacgttcctcaccagctaagctgtgctgagaagtgggtaagctaggtagtagcccacagcagagcccaagaccacaccaaggaaaatccaggtgttgtaggacattacggccagcatgatgaagtagccgatgaccacctggatgacatggattagagactggccaaagtgacacaaataccacctagataaaaaggagaagcaagttaatcctggtaatgagctggtaatgaggaagctgggagtagatatcagggagtagaaagctgttgagttacgtgacccgattgatttataacttgtatgcttaacccaggagtgatttctttctgcccctcccacccccgcccccagaaaaaactcgagatttatttttaaagagacatatcttcactacatttggtttcaagcttcctggcatcctaggcaaaggggaaaatgagggtatctataatctgtctttctgataaggaataagagaaaatcatcagtaaggcatatttcccccctgaatctacttcgggaggcagtatgacaatggaaagaaaaagcatggtcttaggtgacattatcagttcctagacctgccactaactaaaagtggcctagacaaatgtcttaacctctctgaacgtaagattccttatcagtaaaacaggaatgagaatacttcccttgcagtgcagttgtgaagatctgagacacccatgtagggtggctagtgatggagcgggcaggcttattaagcacaggtgaggctggggctggacagagggcagaacagggaccctaaatggttgcctgattcgagtgggaagggaggagaggagagcttgtcatcctcctcccaccaagtgggatacattgcttcaggacagctgcagatcccctcctggatatgggagcctagtgacccatggaactggtgagatttgggggagggtgggtggccacctcatttgctagataggggcctgcacctgaagatcactgttccctaaagaaagccttctgagcctctcaagtggctggctgttcacagagtgctttggcctgggcatcaggagacatgagctctagttcacttggctatgtgtagccactttggcaagtcctggtccttccctgggcctcgctgtcctctctgtgaagtggggctaatgctgtctgggccagcctgtctctcagggtgaatgtgaggcttctgcccctttcccatacccactgcctgtacctgtggtgggttctgccaacagggaatgaatctgagcctgcagagtccccgtctgtctctgcgatggtctgctggctgatggaggttggcaggttcaccagtacctggttgagcagcttggctttgccaaccttgatgccttcatacagtacagccagaagcaggagcaccaacaccgaaagggccatgcctgtcaaaggaggcagagttgtggagacctggccaggccagcactgtttcccttccagcacctccacctgttcatggaatccactccatccacctctatcctgcaccttcttccccacccttgctgagttccgaacttcttcactgtcttcaccagacttttcttagctggagtgtggctttgagatcaggaagagaagccacctgaaaaatccaggggctgagggtgaagaagccacgtaccattaccccacccactcccccagcaggctgcacaaatctgtcgtgacttcttgttaagtgatgagtactgcaaggtcctatttatatgtaagtatgcaaaaaatgtctggaaggaaagataaatagcacaagagtaatagttatctcagcaaagtaggatacaggtggtttttatgttcttgcctaactttctaaggtttcttttatatatattacttttataataggggaaaaacccaataaattattttaccaaaacta

SEQ ID NO: 134660 - DNA, 705 bp, Homo sapiens
  Payload ID: 6309
  Gene Symbol: FKBP1A
  Gene Name: FK506 binding protein 1A, 12kDa
  ENST ID: ENST00000381715
  CDS Start-End: 60-371
ggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaa

SEQ ID NO: 134661 - DNA, 747 bp, Homo sapiens
  Payload ID: 6309
  Gene Symbol: FKBP1A
  Gene Name: FK506 binding protein 1A, 12kDa
  Uniprot ID: P62942
  ENST ID: ENST00000381719
  CDS Start-End: 31-357
ccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaat

SEQ ID NO: 134662 - DNA, 976 bp, Homo sapiens
  Payload ID: 6309
  Gene Symbol: FKBP1A
  Gene Name: FK506 binding protein 1A, 12kDa
  ENST ID: ENST00000381724
  CDS Start-End: 136-447
gcccgtcgcgccgcccgcccgctcagcgtccgccgccgccatgggagtgcaggtggaaaccatctccccaggagacggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctt

SEQ ID NO: 134663 - DNA, 1622 bp, Homo sapiens
  Payload ID: 6309
  Gene Symbol: FKBP1A
  Gene Name: FK506 binding protein 1A, 12kDa
  Uniprot ID: P62942
  ENST ID: ENST00000400137
  CDS Start-End: 165-491
gtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctca

SEQ ID NO: 134664 - DNA, 1583 bp, Homo sapiens
  Payload ID: 6309
  Gene Symbol: FKBP1A
  Gene Name: FK506 binding protein 1A, 12kDa
  ENST ID: ENST00000439640
  CDS Start-End: 175-453
tttccgggacgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctc

SEQ ID NO: 134665 - DNA, 1518 bp, Homo sapiens
  Payload ID: 6309
  Gene Symbol: FKBP1A
  Gene Name: FK506 binding protein 1A, 12kDa
  ENST ID: ENST00000618612
  CDS Start-End: 175-468
tttccgggacgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctc

SEQ ID NO: 134666 - DNA, 409 bp, Homo sapiens
  Payload ID: 6309
  Gene Symbol: FKBP1A
  Gene Name: FK506 binding protein 1A, 12kDa
  ENST ID: ENST00000612074
  CDS Start-End: 1-114
atgggagtgcaggtggaaaccatctccccaggagacgggcgcaccttccccaagcgcggccagacctgcgtggtgcactacaccggtggtgactgcattctggtaaacgaatgagctaaatgcataccccagctcaccagttctggggcaccagttccttggagcagggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatga

SEQ ID NO: 134667 - DNA, 562 bp, Homo sapiens
  Payload ID: 6309
  Gene Symbol: FKBP1A
  Gene Name: FK506 binding protein 1A, 12kDa
  ENST ID: ENST00000614856
  CDS Start-End: 167-556
acgtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccaggtatgctctctcatttgttttgttttgctttctagtatttaccttttatatttttttataggtggcatatttatacggttcaaaaataaaaaaagtgaaaagtctcaccctcatgccatcccatctgaccaatacccccacaagaagctcctgttgttaatgtttcttgtactgtggtttaagcacatataaaaacat

SEQ ID NO: 134668 - DNA, 952 bp, Homo sapiens
  Payload ID: 6310
  Gene Symbol: FKBP1B
  Gene Name: FK506 binding protein 1B, 12.6 kDa
  Uniprot ID: P68106
  ENST ID: ENST00000380986
  CDS Start-End: 137-463
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 134669 - DNA, 1010 bp, Homo sapiens
  Payload ID: 6310
  Gene Symbol: FKBP1B
  Gene Name: FK506 binding protein 1B, 12.6 kDa
  Uniprot ID: P68106
  ENST ID: ENST00000380991
  CDS Start-End: 150-392
ccgcgcaggtcccgactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 134670 - DNA, 859 bp, Homo sapiens
  Payload ID: 6310
  Gene Symbol: FKBP1B
  Gene Name: FK506 binding protein 1B, 12.6 kDa
  ENST ID: ENST00000421839
  CDS Start-End: 1-128
tccccaagaagggccaaacgtgtgtggtgcactacacagccagtctagtgggaatgataaaggaggcttggaaggccaactctttccctcttctaccagcaagggccatccatggtgccagcttctaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 134671 - DNA, 953 bp, Homo sapiens
  Payload ID: 6310
  Gene Symbol: FKBP1B
  Gene Name: FK506 binding protein 1B, 12.6 kDa
  ENST ID: ENST00000452109
  CDS Start-End: 235-474
acggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggcgaggtagagtgagttcttcaggactgctggcaggaagatcatgagcaggtgtttgttccaagggaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgt

SEQ ID NO: 134672 - DNA, 1137 bp, Homo sapiens
  Payload ID: 6310
  Gene Symbol: FKBP1B
  Gene Name: FK506 binding protein 1B, 12.6 kDa
  ENST ID: ENST00000438630
  CDS Start-End: 120-293
ctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacagccagtctagtgggaatgataaaggaggcttggaaggccaactctttccctcttctaccagcaagggccatccatggtgccagcttctaggcgaggtagagtgagttcttcaggactgctggcaggaagatcatgagcaggtgtttgttccaagggaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaa

SEQ ID NO: 134673 - DNA, 1579 bp, Homo sapiens
  Payload ID: 6311
  Gene Symbol: FKBP1C
  Gene Name: FK506 binding protein 1C
  ENST ID: ENST00000370659
  CDS Start-End: 112-438
atgggcaggcaacgcgctgagggactaggcagagccgtggaaccgccgccaggtcgctgtcggtccacgccgcccgtcgcgctgcccgcccgctcggcgtcggccgccgccatgggagtgcacgtggaaaccatctccccaggagactggcgcaccttcccgaagcgcagccagacctgcgtgatgcactacaccgggatgcttgaagatggaaagaaatttgattcctcccgggacagaaacaagccctttaagtttatgctaggcaagcaggaggtgatccgaggctgggaagaaggggttgtccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacgtgtgcacataaatccatatggagcttttcctgatgttccactccactttgtatagacatctgccccaactgaatgtgttctgtcactcagctttgcttccgacacctctgtttcctcttcccctttctcctggtatgtgcgtttacctaaactatatgccataaacgtcaagttattcattttactttttcattttggggtgaagattcagtttcagtcttttgaatataggtttccaattaagtacatggtcaagtgttaacagcacaagtgataagttaacgttaggataggaattggtgttgagggggttgcaagaatattttattttaattttttggatgaaatttttatctattatatattaaacattcttgctgctgcgctgcaaaaccatagcagatttgaggcactgttgaggactgaattattctccaagttgagagatgtccttgggttaaattaaaagccctacctaaaactgaggtggggatggggagaggctttgcctccaccattcccaccccaccctccccttaaaccctctgcctttgaaagcaggtcatgttcactgcgatgctggacactacaggtatctgtccctgggccagcagggacctctgaagccttctttgtggccttatttttttttttttttttttcatcctgtggtttttctaacggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcccagcttcagcatctcctgttttttgatgcttggctccctctgctgatctcagagtttcctggcttttcctccctcagccacttctcacccctttgctgtcctgtgtagtgatttggtgagaggaatcgttgctgcccccttcccctagcaccatatatgagtctcaagttttattattgcaataaaagtgctttatgctggcttttctcaaa

SEQ ID NO: 134674 - DNA, 657 bp, Homo sapiens
  Payload ID: 6312
  Gene Symbol: FKBP2
  Gene Name: FK506 binding protein 2, 13kDa
  Uniprot ID: P26885
  ENST ID: ENST00000309366
  CDS Start-End: 134-562
ggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaa

SEQ ID NO: 134675 - DNA, 1002 bp, Homo sapiens
  Payload ID: 6312
  Gene Symbol: FKBP2
  Gene Name: FK506 binding protein 2, 13kDa
  Uniprot ID: P26885
  ENST ID: ENST00000394540
  CDS Start-End: 471-899
gtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcgtgagtggggccgcccagtcggggcaactgcagtgcagccagatagggtctggactttgcgtaaagggacaggcgggaactgaagagcggaggtggggactgggagggagggaaggtatgggggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcccaa

SEQ ID NO: 134676 - DNA, 613 bp, Homo sapiens
  Payload ID: 6312
  Gene Symbol: FKBP2
  Gene Name: FK506 binding protein 2, 13kDa
  Uniprot ID: P26885
  ENST ID: ENST00000449942
  CDS Start-End: 88-516
ctggggggagccggggtgcaagagggcaggctggatcaggccgggcagaagcggaccgggctccgagtgtcaacgagagctagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggtggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaa

SEQ ID NO: 134677 - DNA, 639 bp, Homo sapiens
  Payload ID: 6312
  Gene Symbol: FKBP2
  Gene Name: FK506 binding protein 2, 13kDa
  ENST ID: ENST00000535135
  CDS Start-End: 334-639
tggccccgggcgtcctcgcgggggtggtctccgtggtggccgggcttggggacgccgtaggccgagaactccaccgggagaggtggtgtgggtggagcgggctcggcggccagcagacacagggccagtctgggtgccccggagacccccaagggctcagagttggggcggcgccccgggcggaagcacagggccaggctggggggtatctcccgaggacccgggctcctcggagccacccagtggggatgtgtgggtgcctcggggccggccccctgcagcggccgcagaggtgttggtgtgctggaccgggggcagctgggtgtggcagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgc

SEQ ID NO: 134678 - DNA, 1684 bp, Homo sapiens
  Payload ID: 6313
  Gene Symbol: FKBP3
  Gene Name: FK506 binding protein 3, 25kDa
  Uniprot ID: Q00688
  ENST ID: ENST00000216330
  CDS Start-End: 412-1086
gtcagcctacatttttttaagtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaatt

SEQ ID NO: 134679 - DNA, 1346 bp, Homo sapiens
  Payload ID: 6313
  Gene Symbol: FKBP3
  Gene Name: FK506 binding protein 3, 25kDa
  Uniprot ID: Q00688
  ENST ID: ENST00000396062
  CDS Start-End: 74-748
gccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaatt

SEQ ID NO: 134680 - DNA, 643 bp, Homo sapiens
  Payload ID: 6313
  Gene Symbol: FKBP3
  Gene Name: FK506 binding protein 3, 25kDa
  ENST ID: ENST00000557324
  CDS Start-End: 28-225
tcagtaaagcggaggcagcgggggaagatggcggcggccgttccacagcgggcgtggaccgtggagcagctgcgcagtgagcagctgcccaagaaggacattatcaagtttctgcaggaacacggttcagattcggctggagtgcagtggcgcgatctcggctcactgcaacctccgcctcccgggttcaaacgattctcctgcctctgcctctcgagtagctaggactacaggcgcgtgccaccacgccagtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcg

SEQ ID NO: 134681 - DNA, 3732 bp, Homo sapiens
  Payload ID: 6314
  Gene Symbol: FKBP4
  Gene Name: FK506 binding protein 4, 59kDa
  Uniprot ID: Q02790
  ENST ID: ENST00000001008
  CDS Start-End: 188-1567
gagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaccctttctgttcagccttggagtggtgggtatgggtgggtacataatgggtagtagcacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacacttaggaagacgaaagtataaagatctagaagactgggacaccatgcatgttcattttgaagttggaattggtcttctgcctacctctgatctggcagaggtatctgcattttggtttgttaacaaggtaaaactcctggtgtcactgacctcctcctgtcagataacttacatgattaaggttaagagtaaagcagagtgttcacgtccagcttccttctcagccttaacaggaaaaggcttgtgctttttttctaactatgctttgacccttaactcctatggcatgatggggccctgggagaagccaggcagcacaagccagtcatgctgagctgcctccagataatcctggctccaggccagagcccgtgtctgccctcatccctctctcctactgtgagctctccagtcctttcccaacagcgatgtggttgtctgcttagccacatgcctgtatagttccttccagaagaaatgtataatggtggaagatgtatttctgtgtgaaaattttcaccaagtcatacaacacagctgatgctggagccaggattaaaattggggtgtacaagtctcccagtgtgagtatcccttgagcccaagacaccaaggatgcagagaactgtgactgtgccactgcacgccagcctgggcaagagagtgagaccatctcttttttaaaaaagtccctgtgtaactgctttcttactgggcttacctcacatcacagccctgtgtttgtggtttgtgtctgggtcctcttggtatttcaaaagtagtagattcttacgcctgcagccaacaataatcactaactcaagcatttatggagtaagcctagcactgtactgacagcatcacatgagtgaaactgaatccttgcaaccatcctacaaagaaggtataactttaataaccctatttacagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgaggatgttttgttaaaa

SEQ ID NO: 134682 - DNA, 370 bp, Homo sapiens
  Payload ID: 6314
  Gene Symbol: FKBP4
  Gene Name: FK506 binding protein 4, 59kDa
  ENST ID: ENST00000539181
  CDS Start-End: 1-254
ccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggcgccgtggctcacacctgcaatcccagcactttgcagagccaaagtgggaggatcacttgaacccagtaggtagagacctcagtgacttaggatggcaccactgcaccccagcctgagtgacaaaatgaaaccccatctcaaaaaaagaaaagcgagatgctttttgtgtgtgattaaataaataataca

SEQ ID NO: 134683 - DNA, 425 bp, Homo sapiens
  Payload ID: 6314
  Gene Symbol: FKBP4
  Gene Name: FK506 binding protein 4, 59kDa
  ENST ID: ENST00000543769
  CDS Start-End: 72-227
cgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtgacttccccttctcgctccagcgtcctgccgttttctacgagattgttattccaggtcatcaagagagagggcacaggtacagagatgcccatgattggggaccgagtctttgtccactacactggctggctattagatggcacaaagtttgactccagtctggatcgcaaggacaaattctcctttgacctgggaaaag

SEQ ID NO: 134684 - DNA, 287 bp, Homo sapiens
  Payload ID: 6314
  Gene Symbol: FKBP4
  Gene Name: FK506 binding protein 4, 59kDa
  ENST ID: ENST00000544366
  CDS Start-End: 1-71
tgaaggaggagcagaagagcaacacggcagggagccagtctcagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgagga

SEQ ID NO: 134685 - DNA, 572 bp, Homo sapiens
  Payload ID: 6314
  Gene Symbol: FKBP4
  Gene Name: FK506 binding protein 4, 59kDa
  ENST ID: ENST00000538622
  CDS Start-End: 315-572
caaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgag

SEQ ID NO: 134686 - DNA, 156 bp, Homo sapiens
  Payload ID: 6314
  Gene Symbol: FKBP4
  Gene Name: FK506 binding protein 4, 59kDa
  ENST ID: ENST00000630279
  CDS Start-End: 1-156
atgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtga

SEQ ID NO: 134687 - DNA, 3772 bp, Homo sapiens
  Payload ID: 6315
  Gene Symbol: FKBP5
  Gene Name: FK506 binding protein 5
  Uniprot ID: Q13451
  ENST ID: ENST00000357266
  CDS Start-End: 154-1527
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtga

SEQ ID NO: 134688 - DNA, 3827 bp, Homo sapiens
  Payload ID: 6315
  Gene Symbol: FKBP5
  Gene Name: FK506 binding protein 5
  Uniprot ID: Q13451
  ENST ID: ENST00000539068
  CDS Start-End: 204-1577
agtctcgggcggcggtgtccggcgcgcgggcggcctgctgggcgggctgaagggttagcggagcacgggcaaggcggagagtgacggagtcggcgagcccccgcggcgacaggtaccggcgccatggccacggagatggggcggccggccgcggcgccccgggagccgaacgccctccttccaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 134689 - DNA, 7384 bp, Homo sapiens
  Payload ID: 6315
  Gene Symbol: FKBP5
  Gene Name: FK506 binding protein 5
  Uniprot ID: Q13451
  ENST ID: ENST00000542713
  CDS Start-End: 159-965
gattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctc

SEQ ID NO: 134690 - DNA, 3940 bp, Homo sapiens
  Payload ID: 6315
  Gene Symbol: FKBP5
  Gene Name: FK506 binding protein 5
  Uniprot ID: Q13451
  ENST ID: ENST00000536438
  CDS Start-End: 317-1690
agaacaaactcctacctctgtttgcaactaagagttacatcccccatgccaagaccttccgaggcgtcccagagggggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcc

SEQ ID NO: 134691 - DNA, 1500 bp, Homo sapiens
  Payload ID: 6316
  Gene Symbol: FKBP6
  Gene Name: FK506 binding protein 6, 36kDa
  Uniprot ID: O75344
  ENST ID: ENST00000252037
  CDS Start-End: 70-1053
gtcacagccagggagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaa

SEQ ID NO: 134692 - DNA, 1507 bp, Homo sapiens
  Payload ID: 6316
  Gene Symbol: FKBP6
  Gene Name: FK506 binding protein 6, 36kDa
  Uniprot ID: O75344
  ENST ID: ENST00000413573
  CDS Start-End: 155-1048
gagtgcctcctcgtggccccagaatggaatgccgccgtcggtaggggtctgccgggcataaaggggccttcggaaccccaccagagtcacagccagggagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaagatccagtataa

SEQ ID NO: 134693 - DNA, 778 bp, Homo sapiens
  Payload ID: 6316
  Gene Symbol: FKBP6
  Gene Name: FK506 binding protein 6, 36kDa
  ENST ID: ENST00000442793
  CDS Start-End: 21-778
gcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctag

SEQ ID NO: 134694 - DNA, 1176 bp, Homo sapiens
  Payload ID: 6316
  Gene Symbol: FKBP6
  Gene Name: FK506 binding protein 6, 36kDa
  ENST ID: ENST00000429879
  CDS Start-End: 97-696
taaaggggccttcggaaccccaccagagtcacagccagggagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagcaccgtgctgggtgtgctgcggctgaacctgttaacagggtccaggaatgtgttaaagcagctgtgagttgtgcaaatagaagaaaaagctctggaagtacttccacaaaatggatggttagacttgatgacgttgtatatgatgaagttgtatatataagagatcaaggaaacagaagaagggaatgacttgaaacttcctggtctgagaaaaaaatttaaaccaaggaataactgggaaagaaatgtgttactttcaattttgattactcatgggaatgagcaggccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatc

SEQ ID NO: 134695 - DNA, 1933 bp, Homo sapiens
  Payload ID: 6316
  Gene Symbol: FKBP6
  Gene Name: FK506 binding protein 6, 36kDa
  ENST ID: ENST00000445032
  CDS Start-End: 118-423
tcggtaggggtctgccgggcataaaggggccttcggaaccccaccagagtcacagccagggagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagagggtaggttcagagtgggagctggagaagaaggaattgtttaggggctagatgaggcacgatgcctcaggctgggaagactgctcagagcgcaggttctttgagttggctttgctgaggctgggttttggtaacacagccatgttctctccccttgagacctaggcatttgggagatggcttaacgggcaaggtataatctttgcactctgacttaactaaccactgggaatgtttctttgttcatttattaagtaaaactcaatcgaatacttacttcccacaatacatggtgaaaagagaggatgtactcagaagattagaacatctccacccttaaggacctcacaatgtagtggaggagactgacctgcactcagctcacttgatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaa

SEQ ID NO: 134696 - DNA, 1446 bp, Homo sapiens
  Payload ID: 6316
  Gene Symbol: FKBP6
  Gene Name: FK506 binding protein 6, 36kDa
  Uniprot ID: O75344
  ENST ID: ENST00000431982
  CDS Start-End: 110-1078
atgtttcgtgcgctcccattacggatcatacctcgcacctcaccgcgtggcctctgtagttccagagctcgcgagggccagggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctattgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgta

SEQ ID NO: 134697 - DNA, 1030 bp, Homo sapiens
  Payload ID: 6317
  Gene Symbol: FKBP7
  Gene Name: FK506 binding protein 7
  ENST ID: ENST00000233092
  CDS Start-End: 77-460
cgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtacttgaagaagtctttcttctgcaaaatatccttgtctcatgtcacagaacaaccctgcatgtcttgaaatgcatgtgacttgttagtgcttaaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaa

SEQ ID NO: 134698 - DNA, 526 bp, Homo sapiens
  Payload ID: 6317
  Gene Symbol: FKBP7
  Gene Name: FK506 binding protein 7
  ENST ID: ENST00000412612
  CDS Start-End: 1-202
cggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtagtacttgaagaagtctttcttctgcaaaatatccttgtctcatgtcacagaacaaccctgcatgtcttgaaatgcatgtgacttgttagtgcttaaataacaatacatgcgaaggcaagattccaccggatgctacattgatttttgagattgaactttatgctgtgaccaaaggaccacggagcattgagacatttaaacaaatagacatggacaatgacaggcagctctctaaagccgagagtgaatagcagctgcagatgaattcgcatagtacccaagagctcagcctatgcacacagaccactcattatcacaggcacaccaagagc

SEQ ID NO: 134699 - DNA, 638 bp, Homo sapiens
  Payload ID: 6317
  Gene Symbol: FKBP7
  Gene Name: FK506 binding protein 7
  ENST ID: ENST00000419184
  CDS Start-End: 97-357
gcaggacaacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttt

SEQ ID NO: 134700 - DNA, 764 bp, Homo sapiens
  Payload ID: 6317
  Gene Symbol: FKBP7
  Gene Name: FK506 binding protein 7
  ENST ID: ENST00000435079
  CDS Start-End: 55-279
atccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcaggtagtacttgaagaagtctttcttctgcaaaatatccttgtctcatgtcacagaacaaccctgcatgtcttgaaatgcatgtgacttgttagtgcttaaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttg

SEQ ID NO: 134701 - DNA, 2834 bp, Homo sapiens
  Payload ID: 6317
  Gene Symbol: FKBP7
  Gene Name: FK506 binding protein 7
  Uniprot ID: Q9Y680
  ENST ID: ENST00000424785
  CDS Start-End: 60-728
gggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatgactgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaa

SEQ ID NO: 134702 - DNA, 666 bp, Homo sapiens
  Payload ID: 6317
  Gene Symbol: FKBP7
  Gene Name: FK506 binding protein 7
  Uniprot ID: Q9Y680
  ENST ID: ENST00000434643
  CDS Start-End: 1-666
atgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatag

SEQ ID NO: 134703 - DNA, 1710 bp, Homo sapiens
  Payload ID: 6318
  Gene Symbol: FKBP8
  Gene Name: FK506 binding protein 8, 38kDa
  Uniprot ID: Q14318
  ENST ID: ENST00000222308
  CDS Start-End: 65-1303
gggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcag

SEQ ID NO: 134704 - DNA, 1292 bp, Homo sapiens
  Payload ID: 6318
  Gene Symbol: FKBP8
  Gene Name: FK506 binding protein 8, 38kDa
  ENST ID: ENST00000544835
  CDS Start-End: 114-861
ggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttccacgga

SEQ ID NO: 134705 - DNA, 1781 bp, Homo sapiens
  Payload ID: 6318
  Gene Symbol: FKBP8
  Gene Name: FK506 binding protein 8, 38kDa
  Uniprot ID: Q14318
  ENST ID: ENST00000597960
  CDS Start-End: 122-1363
aagcggccgaacctggttcccgaggcgcggcggccgcggctgggggcggggaggggggcgcaggaccccaagtgggggtcccggagccagaggcaaggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttccacggac

SEQ ID NO: 134706 - DNA, 574 bp, Homo sapiens
  Payload ID: 6318
  Gene Symbol: FKBP8
  Gene Name: FK506 binding protein 8, 38kDa
  ENST ID: ENST00000597547
  CDS Start-End: 85-574
aagtgtcctggggtgctgggggcgccgtgccggccgggccgctgccctggcctaggctgggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatgg

SEQ ID NO: 134707 - DNA, 593 bp, Homo sapiens
  Payload ID: 6318
  Gene Symbol: FKBP8
  Gene Name: FK506 binding protein 8, 38kDa
  ENST ID: ENST00000594844
  CDS Start-End: 91-593
gtgcagggccaggggcgcccgaggcgtgcgggggtcgggtgccccagactggtggcgtcagacagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagac

SEQ ID NO: 134708 - DNA, 1756 bp, Homo sapiens
  Payload ID: 6318
  Gene Symbol: FKBP8
  Gene Name: FK506 binding protein 8, 38kDa
  Uniprot ID: Q14318
  ENST ID: ENST00000596558
  CDS Start-End: 111-1349
gaattgtgcgggcgcggggaattatgggggtgggggctgggagggtctctcaaagtggggctccgagcccgggaggagcaggcagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcag

SEQ ID NO: 134709 - DNA, 966 bp, Homo sapiens
  Payload ID: 6318
  Gene Symbol: FKBP8
  Gene Name: FK506 binding protein 8, 38kDa
  ENST ID: ENST00000597611
  CDS Start-End: 195-966
ttctgtatgcctttgggcacgtcactcctcctcaggccctcaggttcacttctgtaactaaggcttcaggatgggtcattcagcaaccccagagctgccctgcccgtcaagcttgaactctttaaggaaataacatttagagtggactgtgcccccagcagcccccaagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaag

SEQ ID NO: 134710 - DNA, 1140 bp, Homo sapiens
  Payload ID: 6318
  Gene Symbol: FKBP8
  Gene Name: FK506 binding protein 8, 38kDa
  ENST ID: ENST00000599540
  CDS Start-End: 529-1140
tttcccccagtggccttagaggctctaaaaatggcttccctaaggcctcggaggctgtcctctccacaaaaatcccagcacccttcgctcagcttataatcaggcaaagccacagggcctgaagccccaggttcaaatcctcctttggcctttggctttctctgtgaccttgggcaaatgcctttgcccctctggcctgtttcctgttctgcaaaatgttgaggggaatcttccctacttcctggagtatttgtaaacattaaataataattagctctaataatggctaacactatttgagcctgatgccaagggcttgatgcatgggttaatttctcccaacaagctggggttgttgttacacccactgtatagatgaggaaactgaggcctggagcccttgagttacacagaaagtgatcggcagtgtggggaatcagtacagtggagactttgaggggctgtgtaggattctgacccacatctctgccccccacttccagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggct

SEQ ID NO: 134711 - DNA, 1548 bp, Homo sapiens
  Payload ID: 6318
  Gene Symbol: FKBP8
  Gene Name: FK506 binding protein 8, 38kDa
  ENST ID: ENST00000601844
  CDS Start-End: 122-472
aagcggccgaacctggttcccgaggcgcggcggccgcggctgggggcggggaggggggcgcaggaccccaagtgggggtcccggagccagaggcaaggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctgggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccc

SEQ ID NO: 134712 - DNA, 612 bp, Homo sapiens
  Payload ID: 6318
  Gene Symbol: FKBP8
  Gene Name: FK506 binding protein 8, 38kDa
  ENST ID: ENST00000596015
  CDS Start-End: 1-548
acgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccc

SEQ ID NO: 134713 - DNA, 460 bp, Homo sapiens
  Payload ID: 6318
  Gene Symbol: FKBP8
  Gene Name: FK506 binding protein 8, 38kDa
  ENST ID: ENST00000606531
  CDS Start-End: 1-311
cctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagcttcccctgccttctgcagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggacc

SEQ ID NO: 134714 - DNA, 1849 bp, Homo sapiens
  Payload ID: 6318
  Gene Symbol: FKBP8
  Gene Name: FK506 binding protein 8, 38kDa
  Uniprot ID: Q14318
  ENST ID: ENST00000608443
  CDS Start-End: 201-1442
acgcccgggacggacgtctgcatgagccaacgggtgcggcagtcgcggcagcggcggccaatgggcacggcaggggcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcag

SEQ ID NO: 134715 - DNA, 220 bp, Homo sapiens
  Payload ID: 6318
  Gene Symbol: FKBP8
  Gene Name: FK506 binding protein 8, 38kDa
  ENST ID: ENST00000609656
  CDS Start-End: 152-220
cgtcactcctcctcaggccctcaggttcacttctgtaactaaggcttcaggatgggtcattcagcaaccccagagctgccctgcccgtcaagcttgaactctttaaggaaataacatttagagtggactgtgcccccagcagcccccaagcatggcatcgtgtgctgaaccctctgagccctctgccccactgcccgccggggtcccaccgctcgaggac

SEQ ID NO: 134716 - DNA, 3462 bp, Homo sapiens
  Payload ID: 6319
  Gene Symbol: FKBP9
  Gene Name: FK506 binding protein 9, 63 kDa
  Uniprot ID: O95302
  ENST ID: ENST00000242209
  CDS Start-End: 170-1882
ccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatta

SEQ ID NO: 134717 - DNA, 780 bp, Homo sapiens
  Payload ID: 6319
  Gene Symbol: FKBP9
  Gene Name: FK506 binding protein 9, 63 kDa
  ENST ID: ENST00000418354
  CDS Start-End: 104-780
aaggagatgcagggtgggctttgccaaaggccagtggaaggagctcaggcttggcggcatctggtttgcttgtctgggcctactcctttgcatgatataacaaatggcagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggg

SEQ ID NO: 134718 - DNA, 3621 bp, Homo sapiens
  Payload ID: 6319
  Gene Symbol: FKBP9
  Gene Name: FK506 binding protein 9, 63 kDa
  Uniprot ID: O95302
  ENST ID: ENST00000538336
  CDS Start-End: 171-2042
cccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccaggtactgggatacagcggaggataaagctgacaaaagtccctgccctcaagtcagggttggggtgaacacaagcccgtcctgcagacttaagcagaaaggagtgggaatttattggaaggatctccaattccttgtgagggtccagaatcatggactgagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatt

SEQ ID NO: 134719 - DNA, 2699 bp, Homo sapiens
  Payload ID: 6319
  Gene Symbol: FKBP9
  Gene Name: FK506 binding protein 9, 63 kDa
  Uniprot ID: O95302
  ENST ID: ENST00000490776
  CDS Start-End: 104-1120
aaggagatgcagggtgggctttgccaaaggccagtggaaggagctcaggcttggcggcatctggtttgcttgtctgggcctactcctttgcatgatataacaaatggcagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatt

SEQ ID NO: 134720 - DNA, 1345 bp, Homo sapiens
  Payload ID: 6320
  Gene Symbol: FKBPL
  Gene Name: FK506 binding protein like
  Uniprot ID: Q9UIM3
  ENST ID: ENST00000375156
  CDS Start-End: 272-1321
agggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 134721 - DNA, 1345 bp, Homo sapiens; identical to SEQ ID NO: 134720
  Payload ID: 6320
  Gene Symbol: FKBPL
  Gene Name: FK506 binding protein like
  Uniprot ID: Q9UIM3
  ENST ID: ENST00000425378
  CDS Start-End: 272-1321

SEQ ID NO: 134722 - DNA, 1345 bp, Homo sapiens
  Payload ID: 6320
  Gene Symbol: FKBPL
  Gene Name: FK506 binding protein like
  Uniprot ID: Q9UIM3
  ENST ID: ENST00000443350
  CDS Start-End: 272-1321
agggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggtttatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 134723 - DNA, 1345 bp, Homo sapiens
  Payload ID: 6320
  Gene Symbol: FKBPL
  Gene Name: FK506 binding protein like
  Uniprot ID: Q9UIM3
  ENST ID: ENST00000456854
  CDS Start-End: 272-1321
agggttagttgtcagtatctttcccagttgttccgccccctacccccgcctcccgcaccgcgcccctctccggctgccctctccgtgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagagacccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 134724 - DNA, 2296 bp, Homo sapiens
  Payload ID: 6321
  Gene Symbol: FEN1
  Gene Name: flap structure-specific endonuclease 1
  Uniprot ID: P39748
  ENST ID: ENST00000305885
  CDS Start-End: 414-1556
aaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaa

SEQ ID NO: 134725 - DNA, 776 bp, Homo sapiens
  Payload ID: 6321
  Gene Symbol: FEN1
  Gene Name: flap structure-specific endonuclease 1
  ENST ID: ENST00000535723
  CDS Start-End: 282-776
gagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcgtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgcc

SEQ ID NO: 134726 - DNA, 768 bp, Homo sapiens
  Payload ID: 6321
  Gene Symbol: FEN1
  Gene Name: flap structure-specific endonuclease 1
  ENST ID: ENST00000535307
  CDS Start-End: 1-463
cctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaa

SEQ ID NO: 134727 - DNA, 2160 bp, Homo sapiens
  Payload ID: 6322
  Gene Symbol: FLAD1
  Gene Name: flavin adenine dinucleotide synthetase 1
  Uniprot ID: Q8NFF5
  ENST ID: ENST00000292180
  CDS Start-End: 323-2086
gccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 134728 - DNA, 1211 bp, Homo sapiens
  Payload ID: 6322
  Gene Symbol: FLAD1
  Gene Name: flavin adenine dinucleotide synthetase 1
  ENST ID: ENST00000295530
  CDS Start-End: 478-990
cttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggaaattacctgatgttccaaaccccctccagatcctgtatatccgcagcatctcccctttccctgagctggaacagtttctacaggacactatcaagagagcaagctataccagagaatcagatagcaagccctccctcagaggccaagggagcagaagagccatggatgggccccttcccaggacagcaggggtagaagtgggaaagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 134729 - DNA, 1730 bp, Homo sapiens
  Payload ID: 6322
  Gene Symbol: FLAD1
  Gene Name: flavin adenine dinucleotide synthetase 1
  Uniprot ID: Q8NFF5
  ENST ID: ENST00000315144
  CDS Start-End: 184-1656
gaacaagggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 134730 - DNA, 1111 bp, Homo sapiens
  Payload ID: 6322
  Gene Symbol: FLAD1
  Gene Name: flavin adenine dinucleotide synthetase 1
  ENST ID: ENST00000368428
  CDS Start-End: 651-1037
gactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgaggatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 134731 - DNA, 1803 bp, Homo sapiens
  Payload ID: 6322
  Gene Symbol: FLAD1
  Gene Name: flavin adenine dinucleotide synthetase 1
  Uniprot ID: Q8NFF5
  ENST ID: ENST00000368431
  CDS Start-End: 821-1705
gaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagttggaaacaacaaatggcttttgagtccaagagtgatgcaatcacagtgacgcattaaaacggttactccggagacatcagagcactgtggctggaggctgggagcctggccaggaagctgtcgccattgtccaggtgaaaggtgctaaggacctgcttggtggcagtggggacagaaagaagaaagcaggccaggcgtggtggctcacacctataattccagcactttgggaggctgaggcaggaggatcacttgagaccaggaattcaacaccagcctgggcaacatggcaagaccccatttctacaaaaaaaatttaaaatgagctgaatgtggtggcacgcgcctgtagtcccagctactcggaaggctggggtggcccttgaagccaggaggttgaggctgcagtgaactgtgactgagccactatactccagcctgggtgacagagacccagctttaaaaccaaacaaatggattttcccactcttgtgtccagtccaggcccctcagcagcctgaggtggtgtccttcaaagagcagagcactgcatcatcaggtggatgcagccatcatcttcaacccctccccttcatccctacagtactgatggcctcatcttccccttcaacccccagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcaggtagggaccttatggaggaggggcattatgcccaaagccattggtggcaccccagatctcagtaatgcaggggctgttgggtgcttcctgcaaatccctgagagggcagaagatagcttctgttaattcattattcttccaataaatgttgattgagtaccta

SEQ ID NO: 134732 - DNA, 1839 bp, Homo sapiens
  Payload ID: 6322
  Gene Symbol: FLAD1
  Gene Name: flavin adenine dinucleotide synthetase 1
  Uniprot ID: Q8NFF5
  ENST ID: ENST00000368432
  CDS Start-End: 178-1518
gggaaagagccggtgaaggggcagaacaggcaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggactggacctacagagacatctgggattttctgcgtcagctgtttgtcccatactgtatcctgtatgaccgagggtaagggtattaggggaagggaatgggtaagggagtttttagggtgctgggatagggagggccaataggatcgcccaccctaccacatgcttgccctccaccctccctgctccagatacacatcactggggagtcgggagaataccgtgcggaacccggccctgaagtgcctgagcccaggaggacaccccacataccgtccagcctatctactggagaacgaagaagaggagcggaactcccgcacatgacctcccaccctaggagggagggaaggacaccgtcctagggtataacctggcaataaaccgtgcctctcactgtg

SEQ ID NO: 134733 - DNA, 2656 bp, Homo sapiens
  Payload ID: 6322
  Gene Symbol: FLAD1
  Gene Name: flavin adenine dinucleotide synthetase 1
  ENST ID: ENST00000368433
  CDS Start-End: 344-1714
aggaaaggaacaagggaaagagccggtgaaggggcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtcaacctttcagattccctctggtctccgtccgaaacgtctacctcttcccaggcattccagagctgctgcggcgggtgctggaggggatgaagggactattccaaaacccagctgttcagttccactcaaaggagctatatgtggctgctgatgaagcctccatcgcccccattctggctgaggcccaggcccactttggacgtaggcttggcctgggttcctaccctgactggggcagcaactactatcaggtgaagctgactctagactcagaggaagaaggacccctggaggaatgcttggcctacctgactgcccgtttgccccagggatcgctggtcccctacatgcccaacgctgtggagcaggccagtgaggctgtatacaaactcgctgaatcagggtcttctttggggaaaaaggtggcaggtgccctacagaccattgagacctccctggctcagtacagcctcacccagctctgtgtgggcttcaacgggggcaaagactgcactgccctcctgcacctcttccatgcagctgtgcagaggaaattacctgatgttccaaaccccctccagatcctgtatatccgcagcatctcccctttccctgagctggaacagtttctacaggacactatcaagaggtactaggggcctggaggtttgggctccaagagaagcttgacagagcccacgcccgacccctacttctgtttcttcctaaggtataatctgcagatgttggaagctgagggcagcatgaagcaggccctgggtgaactgcaggcacggcacccccagctggaggctgtccttatgggcacccgccggactgacccctactcctgtagcctctgccctttcagccccactgacccaggctggcccgcattcatgcgcatcaacccactgctggtaatggggaagagggtttatcaccttcagtctcacgtgccccagcagtcactgcaccctagctcacctgcagtagtggggaggctagagcctggaacctggatgaaggggcctcatcatccaagggaggcagtgctatctgttcattcatccttttgaccaatatttattgagcccaaattcaatagcaggcattgcacttcctactgtggatagaatagtgacttagacttgtgctgtccaatatagccattaattatttatttatacttaaattttaattaattagaatgaaatacatatgactaaaaaccactgaattatatactttaaaaggatgaatttgatggtatgtggatacctcaatttttaaaattaagtacaattaaaaattcagttctggctgggcgcagtggctcacgcctgtaatcccagcactttgggaggccatggtgggcagatcacttgaggccaggagttcgagaccagcctggccaacatggcgaaaccctgtctctactaaaaatacaaaaaattagccaggcgtggtggcctgtagtcctagttactcgagaggctgaggcaggagaattgcttgaacccaggagacggaggttgcagtgagctgagatggcaccactgtactccagcctgggcaacagaacaagactctgtctc

SEQ ID NO: 134734 - DNA, 2160 bp, Homo sapiens
  Payload ID: 6323
  Gene Symbol: FMO1
  Gene Name: flavin containing monooxygenase 1
  Uniprot ID: Q01740
  ENST ID: ENST00000354841
  CDS Start-End: 132-1730
cgctacagaagattcaaactgagcaaatcgcctaatcttccaaattctttttcctggcttgttagagcagccaagggtggggtggagcttgtgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaa

SEQ ID NO: 134735 - DNA, 2155 bp, Homo sapiens
  Payload ID: 6323
  Gene Symbol: FMO1
  Gene Name: flavin containing monooxygenase 1
  Uniprot ID: Q01740
  ENST ID: ENST00000367750
  CDS Start-End: 123-1721
aggtttatccactgtgctggggactcccaagccagcactggctcatactgattcattttgatctctgctaataccagagtcctgcgtggcagagccattggcaccagaaattacaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaagtga

SEQ ID NO: 134736 - DNA, 2003 bp, Homo sapiens
  Payload ID: 6323
  Gene Symbol: FMO1
  Gene Name: flavin containing monooxygenase 1
  Uniprot ID: Q01740
  ENST ID: ENST00000402921
  CDS Start-End: 160-1569
aaatttaacattccttatctcttagaccaggtttatccactgtgctggggactcccaagccagcactggctcatactgattcattttgatctctgctaataccagagtcctgcgtggcagagccattggcaccagaaattacaagtacgtaaagagaacatggccaagcgagttgccattgtgggagctggggtcagcggcctggcctccatcaagtgctgtctggaagaaggactggagcccacctgctttgagaggagcgatgaccttggggggctgtggagattcaccaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaagtga

SEQ ID NO: 134737 - DNA, 757 bp, Homo sapiens
  Payload ID: 6323
  Gene Symbol: FMO1
  Gene Name: flavin containing monooxygenase 1
  ENST ID: ENST00000433267
  CDS Start-End: 132-757
aggtttatccactgtgctggggactcccaagccagcactggctcatactgattcattttgatctctgctaataccagagtcctgcgtggcagagccattggcaccagaaattacaagtacgtaaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaa

SEQ ID NO: 134738 - DNA, 2192 bp, Homo sapiens
  Payload ID: 6323
  Gene Symbol: FMO1
  Gene Name: flavin containing monooxygenase 1
  Uniprot ID: Q01740
  ENST ID: ENST00000617670
  CDS Start-End: 160-1758
aaatttaacattccttatctcttagaccaggtttatccactgtgctggggactcccaagccagcactggctcatactgattcattttgatctctgctaataccagagtcctgcgtggcagagccattggcaccagaaattacaagtacgtaaagagaacatggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttggtttggcttgtgctactgcaaggctttacaatcagattatatcacatacatagatgaactcctgacctatatcaatgcaaaacccaacctgttctctatgctcctaacggatccacatctggctctgaccgtcttctttggcccatgctcaccataccagttccgcttgactggcccaggaaaatgggaaggagccagaaatgccatcatgacccagtgggaccgaacattcaaggtcatcaaagctcgagttgtacaagagtctccatctccctttgaaagttttcttaaagtctttagctttctggctttgcttgtggctatttttctgattttcctataagtaaaagatctcctaaatggaagatgcacagagtagatttacaatgctccaattcctctcttacagcaatattgccttcacagttataaactgtattcaaatagtaaaggccaccctctcgcttccctggctggccccagggctaccactggtattcctgagcctctcccagctccacttctaatgctagagaatgataactaagacttctgtgcatttgaaggttgttggaaagttacaggttcattttagaaagaaagctgttcttgacagcactctgagccatcatacctctttcccatataaactattttcacagatctcaactaaaaccccttacttcacaaatgattgtgttgtgctgaaatggtgctcttatagtactggcttattaaaagtaaaaaataaacctaaaaattgattgttttaagtga

SEQ ID NO: 134739 - DNA, 3851 bp, Homo sapiens
  Payload ID: 6324
  Gene Symbol: FMO2
  Gene Name: flavin containing monooxygenase 2 (non-functional)
  Uniprot ID: Q99518
  ENST ID: ENST00000209929
  CDS Start-End: 159-1766
ttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctatcagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgccaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagta

SEQ ID NO: 134740 - DNA, 1444 bp, Homo sapiens
  Payload ID: 6324
  Gene Symbol: FMO2
  Gene Name: flavin containing monooxygenase 2 (non-functional)
  ENST ID: ENST00000529935
  CDS Start-End: 1-462
acacaaccaagggagaaaactattctgtcaaagagacggtgccaaaaggcaaaaacaaaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctatcagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaag

SEQ ID NO: 134741 - DNA, 583 bp, Homo sapiens
  Payload ID: 6324
  Gene Symbol: FMO2
  Gene Name: flavin containing monooxygenase 2 (non-functional)
  ENST ID: ENST00000483192
  CDS Start-End: 191-583
aagaaactcagcttttctcaaaggcaagaagagagcaggatttttgactggctctttattcaatagtgctgcttattaaattaccactgctacaatgtttaaagccaattacctgagcacatcataaggattctcttaccggttgtcccagttaagtaatgttgattgatcaactccttgacaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagc

SEQ ID NO: 134742 - DNA, 2087 bp, Homo sapiens
  Payload ID: 6325
  Gene Symbol: FMO3
  Gene Name: flavin containing monooxygenase 3
  Uniprot ID: P31513
  ENST ID: ENST00000367755
  CDS Start-End: 112-1710
gtaggctcactagaacattttctctttcaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataa

SEQ ID NO: 134743 - DNA, 582 bp, Homo sapiens
  Payload ID: 6325
  Gene Symbol: FMO3
  Gene Name: flavin containing monooxygenase 3
  ENST ID: ENST00000472784
  CDS Start-End: 72-218
cggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcaaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttacc

SEQ ID NO: 134744 - DNA, 723 bp, Homo sapiens
  Payload ID: 6325
  Gene Symbol: FMO3
  Gene Name: flavin containing monooxygenase 3
  ENST ID: ENST00000479749
  CDS Start-End: 70-723
gttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtc

SEQ ID NO: 134745 - DNA, 2252 bp, Homo sapiens
  Payload ID: 6326
  Gene Symbol: FMO4
  Gene Name: flavin containing monooxygenase 4
  Uniprot ID: P31512
  ENST ID: ENST00000367749
  CDS Start-End: 331-2007
agaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacacaaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggttta

SEQ ID NO: 134746 - DNA, 2632 bp, Homo sapiens
  Payload ID: 6327
  Gene Symbol: FMO5
  Gene Name: flavin containing monooxygenase 5
  Uniprot ID: P49326
  ENST ID: ENST00000254090
  CDS Start-End: 390-1991
aaaaaccaggaagttaaaagtggatgcagaagcgagcacagacggggctaggggtttcagagaaagtaattgagagtgctggcaacagcagctgaaatatagagaagttgtaggattaactttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatagtaatttgacaacagccgcctgttgagtctcctccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaact

SEQ ID NO: 134747 - DNA, 2168 bp, Homo sapiens
  Payload ID: 6327
  Gene Symbol: FMO5
  Gene Name: flavin containing monooxygenase 5
  Uniprot ID: P49326
  ENST ID: ENST00000369272
  CDS Start-End: 281-1138
tgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtctaaagacattgccctcacagagtgaaatgatggcagaaatatctaaagctcaagaggaaattgacaaaaggtatgtggagagccaacgccataccattcagggagactacatagataccatggaagagcttgctgatttggtgggggtcaggcccaatctgctgtctctggccttcactgaccccaagctggcattacacttattactgggaccctgcactccaatccactatcgtgtacagggccctggaaagtgggatggggctcgaaaagctatcctcaccacagatgatcgcatcaggaagcctctgatgacaagagtagttgaaaggagtagttctatgacttcaacaatgacaataggcaagtttatgctagctcttgccttctttgctataattatagcttacttctagttgtcctattgtcactgccctgtttttcattgggaagcttatctacagatgccttcagaatctgacgagattgactctcagtttcatattgcccagaaatctactttaatgtctctttcgaaagcattaattcactttcctttttcctacaatgaaacctgttttccatttgtattaactcatctcccttccactcatgatccgtcactcttccttgtggtaatccctagactgggagctcaggtactcttttagtcatctttgtatgtctttagcagagttcttgacatgtggtaggtgcttaataaatgtttgttgtttatcaaattttatggtagggagagtaagtcagcatcggtataaaatcgcttactccacgtaactcttcttctgatagggtttgattttctattagaagctcaattttagttttttttcatattataactaaatatgtttcctgagagataagagaaataatgttcctacaatagttgtatgtatctaagataagacatatagatgcttaagacattttgtttcacttgctattcactagtgtacttgaaacatggtcatttttagcccttttccttaggaaccatgtctttattttctcaataaagaaattactttcaa

SEQ ID NO: 134748 - DNA, 1696 bp, Homo sapiens
  Payload ID: 6327
  Gene Symbol: FMO5
  Gene Name: flavin containing monooxygenase 5
  Uniprot ID: P49326
  ENST ID: ENST00000441068
  CDS Start-End: 115-1509
aacagccgcctgttgagtctcctccagatcgcagctgaaggatctgttgagcgcttcaggaaaggcggtgagatccggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaagtctaaccatgagaaaaacatcagacaaacccaagttgaagaatattctacaaatacctgactacctcaaaactgtcaagatcatcaacaaagaaagtctgagaaattgtcccggaataaaggggcctaaggagacataacatctaaatgtaatgtagtatcctggatggactcctgcaacagaaaaagaactttaagtaaaaattaagggaatattaataaagtatgcattttggttaataatgtatcaatattggtttattagttgtgacaaatgtaccagaggaatgtaaaatgtcaacaataaaggaaattggatgtggggta

SEQ ID NO: 134749 - DNA, 618 bp, Homo sapiens
  Payload ID: 6327
  Gene Symbol: FMO5
  Gene Name: flavin containing monooxygenase 5
  ENST ID: ENST00000533848
  CDS Start-End: 183-618
ctttttcggggagctcggctcttaagacgcgagtctgccgacgctcccggccgaataaaaacctcttccttctttaattcggtgtctgaggagttttgtctgtggctcatcctgctacaatctgtttgaacagatcacctgaaaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatgg

SEQ ID NO: 134750 - DNA, 2410 bp, Homo sapiens
  Payload ID: 6327
  Gene Symbol: FMO5
  Gene Name: flavin containing monooxygenase 5
  ENST ID: ENST00000527849
  CDS Start-End: 276-1112
attcatctggcgtccgccggccccgcgcgccgcgcaggcgggggccgtggccaccaagcccgggcgcagtttctctccgcccacggcaggagcgaaggaaggccctggcgcgagcgggtaaactgcccaccgggcggcccacccgctgcgcccccggcccgcaagaggcagtcccaataggttggcccgcctggccgaagtccgcccggagcccgctcacctgtcagcccccactgccgacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaagggtggttctgaggatcacatgatagaatttacatgcaaatcctttggaatctgaaaggaaaaattatgatactatttggggaaaattctgtacctttgaattgggtctatcttcctttaggtgagcagaatcactattatttctctgcctgtataaaaactataaaaagattaaaatcaatggtatttgtttaaaaataattagtttacccaatggttgagtagtctcttgtgtataaactcatatattttgctaatgctgattttattaatagtttttaatttaggcataattttcatacaataaaaatttactttttattgtacagtttggtaagtatcaataactccactgcagtcaagatacagacctgttccatacctccccttcaaaatttcttcatgcccttttgtagtcaatcactccccaccccccacccccaagtcctggcaaacactgatctgttttctgaccgtatagtcttcctttttccagaatgtcacataagtggagcctggcttcttttacttcccataatgcatttgagattcatcaatattattgtatgtatcgagttattcttttattactgagtagtattccatttatagctatgctacattttaattattgattcaccagatgtattagcctattttcacactgctataaagacatacctgagactaggtaatttataaagaaaagaggtttaatttacttatagttctgcatggctggggaggacttcagaaacttacagttatggtagaagggaagcaagctcatcttatgtggcacaggggagagacagtgagtgtgtgtgaatgaaggaagaactgccaaacacttttaaaaccatcatctctggtgagaattcatgcaccatcacaagaacagcatgggggaaaccgcccccatcatccaatcacttccctcccttgacacgtgaaggttataggtccttccttcaacacgtgggtattacaatttgagatgagatttgggtggggacacagaaccaaaccatatcaccaggt

SEQ ID NO: 134751 - DNA, 671 bp, Homo sapiens
  Payload ID: 6327
  Gene Symbol: FMO5
  Gene Name: flavin containing monooxygenase 5
  ENST ID: ENST00000533174
  CDS Start-End: 96-671
aggaagttaaaagtggatgcagaagcgagcacagacggggctaggggtttcagagaaagacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggc

SEQ ID NO: 134752 - DNA, 1784 bp, Homo sapiens
  Payload ID: 6327
  Gene Symbol: FMO5
  Gene Name: flavin containing monooxygenase 5
  Uniprot ID: P49326
  ENST ID: ENST00000578284
  CDS Start-End: 390-1784
aaaaaccaggaagttaaaagtggatgcagaagcgagcacagacggggctaggggtttcagagaaagtaattgagagtgctggcaacagcagctgaaatatagagaagttgtaggattaactttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatagtaatttgacaacagccgcctgttgagtctcctccagatcgcagctgaaggatctgttgagcgcttcaggaaaggcggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaagggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacagagctctgagtcagcatccaaccttaaatgatgacctgccaaatcgtatcatttctggcttggtgaaagtgaaaggaaatgtgaaggaattcacggagacagctgccatatttgaggatggctccagggaggatgacattgatgctgttatctttgccacaggctatagctttgactttccatttctggaagattccgtcaaagtggtcaaaaacaagatatccctgtataaaaaggtcttccctcctaacctggaaaggccaactcttgcaatcataggcttgattcagcccttaggagccattatgcccatttcagagctccaaggacgctgggccactcaggtatttaaaggtctaaagacattgccctcacagagtgaaatgatggcagaaatatctaaagctcaagaggaaattgacaaaagtctaaccatgagaaaaacatcagacaaacccaagttgaagaatattctacaaatacctgactacctcaaaactgtcaagatcatcaacaaagaaagtctgagaaattgtcccggaataaaggggcctaaggagacataa

SEQ ID NO: 134753 - DNA, 4151 bp, Homo sapiens
  Payload ID: 6328
  Gene Symbol: FLI1
  Gene Name: Fli-1 proto-oncogene, ETS transcription factor
  Uniprot ID: Q01543
  ENST ID: ENST00000281428
  CDS Start-End: 713-1873
agagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 134754 - DNA, 3427 bp, Homo sapiens
  Payload ID: 6328
  Gene Symbol: FLI1
  Gene Name: Fli-1 proto-oncogene, ETS transcription factor
  Uniprot ID: Q01543
  ENST ID: ENST00000344954
  CDS Start-End: 370-1149
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattct

SEQ ID NO: 134755 - DNA, 3130 bp, Homo sapiens
  Payload ID: 6328
  Gene Symbol: FLI1
  Gene Name: Fli-1 proto-oncogene, ETS transcription factor
  ENST ID: ENST00000429175
  CDS Start-End: 172-420
caacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcag

SEQ ID NO: 134756 - DNA, 3859 bp, Homo sapiens
  Payload ID: 6328
  Gene Symbol: FLI1
  Gene Name: Fli-1 proto-oncogene, ETS transcription factor
  Uniprot ID: Q01543
  ENST ID: ENST00000534087
  CDS Start-End: 321-1580
aacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 134757 - DNA, 4127 bp, Homo sapiens
  Payload ID: 6328
  Gene Symbol: FLI1
  Gene Name: Fli-1 proto-oncogene, ETS transcription factor
  Uniprot ID: Q01543
  ENST ID: ENST00000527786
  CDS Start-End: 490-1848
aggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattcta

SEQ ID NO: 134758 - DNA, 561 bp, Homo sapiens
  Payload ID: 6328
  Gene Symbol: FLI1
  Gene Name: Fli-1 proto-oncogene, ETS transcription factor
  ENST ID: ENST00000527767
  CDS Start-End: 244-561
ctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgagg

SEQ ID NO: 134759 - DNA, 2577 bp, Homo sapiens
  Payload ID: 6328
  Gene Symbol: FLI1
  Gene Name: Fli-1 proto-oncogene, ETS transcription factor
  ENST ID: ENST00000608303
  CDS Start-End: 249-398
acagtctctccatctgcatccccacttcatcaccatcccaccgtctctccctcgctccactcgcgggtaaccgaggcttctccctcccaggctggttcttgggcgttcccgacccttagctacccacgatgtttcagacagtccccgacacgtcgtcttacatcaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctca

SEQ ID NO: 134760 - DNA, 4338 bp, Homo sapiens
  Payload ID: 6329
  Gene Symbol: FLII
  Gene Name: flightless I actin binding protein
  Uniprot ID: Q13045
  ENST ID: ENST00000327031
  CDS Start-End: 227-4036
aactccagcacagggggggcccgcactccttggtgcctccgcagtcttcgaacagacggggaaactgaggccctaagaggcctaaagcctacacttccccgcggaatgcggcgggcgcgggcgggttaaaggggcggggccggcgctggcccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaa

SEQ ID NO: 134761 - DNA, 3975 bp, Homo sapiens
  Payload ID: 6329
  Gene Symbol: FLII
  Gene Name: flightless I actin binding protein
  Uniprot ID: Q13045
  ENST ID: ENST00000545457
  CDS Start-End: 34-3678
agcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacaggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatt

SEQ ID NO: 134762 - DNA, 4148 bp, Homo sapiens
  Payload ID: 6329
  Gene Symbol: FLII
  Gene Name: flightless I actin binding protein
  ENST ID: ENST00000578101
  CDS Start-End: 16-171
agcgagagcggcgccatggaggccaccggggtgctgccgttcgtgcgtggcgtggacctcagcggcaacgacttcaagatggtgagagttggttctgtggctccccaaaggctcccatgggctggaggagccatagaaggtggtgagcaggggctctgtgcttcaccttgacatccttcccccagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtg

SEQ ID NO: 134763 - DNA, 2377 bp, Homo sapiens
  Payload ID: 6329
  Gene Symbol: FLII
  Gene Name: flightless I actin binding protein
  ENST ID: ENST00000578558
  CDS Start-End: 37-2139
cctagcccggcgcggcccggcagcgagagcggcgccatggaggccaccggggtgctgccgttcgtgcgtggcgtggacctcagcggcaacgacttcaagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaa

SEQ ID NO: 134764 - DNA, 385 bp, Homo sapiens
  Payload ID: 6329
  Gene Symbol: FLII
  Gene Name: flightless I actin binding protein
  ENST ID: ENST00000581401
  CDS Start-End: 1-90
cccccgcagatgcgccgcctggtgcacctgcagacgctcgtgctcaatggaaaccccctgctgcatgcacagctccgctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaa

SEQ ID NO: 134765 - DNA, 3936 bp, Homo sapiens
  Payload ID: 6329
  Gene Symbol: FLII
  Gene Name: flightless I actin binding protein
  Uniprot ID: Q13045
  ENST ID: ENST00000579294
  CDS Start-End: 81-3857
ttcctgtcccgctcggctccaggccctgcgtgtcccagggactgcggccggggcggggtggggctctcccctggccaggaatggacctccgaggcctccgcccagtgcctggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctgcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgtttgacaacgacatctcctacattgagggtggaacagccagtggcttctacactgtggaagacacacactatgtcaccaggatgtatcgtgtgtatgggaaaaagaacatcaagttggagcctgtgcccctcaaggggacctctctggacccaaggtttgttttcctgctggaccgagggctagacatctacgtatggcggggggcccaggccacactgagcagcaccaccaaggccaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgggcctgggcttgggctacctggagctgccacagatcaactacaagctctccgtggaacataagcagcgtcccaaggtggagctgatgccaagaatgcggctgctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcatccagatcaacaccgactccagcctcctcaactccgagttctgcttcatcctcaaggttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactca

SEQ ID NO: 134766 - DNA, 555 bp, Homo sapiens
  Payload ID: 6329
  Gene Symbol: FLII
  Gene Name: flightless I actin binding protein
  ENST ID: ENST00000577485
  CDS Start-End: 1-555
aacctcactgacctactatacctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggaggccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggta

SEQ ID NO: 134767 - DNA, 838 bp, Homo sapiens
  Payload ID: 6329
  Gene Symbol: FLII
  Gene Name: flightless I actin binding protein
  ENST ID: ENST00000488932
  CDS Start-End: 1-838
cccgatgacatcttcaagctagatgatctctcagtcctggacttgagccacaaccagctgacagagtgcccgcgggagctggagaacgccaagaacatgctggtgctgaacctcagccacaacagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgccctcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatccatttcctgacggagatcgaggtcctggatgtgcgggagaaccccaacctggtcatgccgcccaagcccgcagaccgtgccgctgagtggtacaacatcgacttctcgctgc

SEQ ID NO: 134768 - DNA, 557 bp, Homo sapiens
  Payload ID: 6329
  Gene Symbol: FLII
  Gene Name: flightless I actin binding protein
  ENST ID: ENST00000577626
  CDS Start-End: 1-354
ctggacctcagcgagaaccgcctggagagcctgcccccgcagatgcgccgcctggtgcacctgcagacgctcgtgctcaatggaaaccccctgctgcatgcacagctccggcagctcccagcgatgacggccctgcagaccctgcacctgcggagcacccagcgcacccagagcaacctgcccaccagcctggagggtctgagcaacctcgcagacgtggatctgtcctgcaatgacctgacacgggtgcccgagtgtctgtacaccctccccagcctgcgccgcctcaacctcagcagcaaccagatcacggagctgtccctgtgcatagaccatcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgcccaaagctgaggaaacttgtcctgaacaagaaccacctggtgaccctcccagaagccatc

SEQ ID NO: 134769 - DNA, 644 bp, Homo sapiens
  Payload ID: 6329
  Gene Symbol: FLII
  Gene Name: flightless I actin binding protein
  ENST ID: ENST00000581858
  CDS Start-End: 1-71
tgaacaccatgtttgacacctcctacagcaagcaggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaa

SEQ ID NO: 134770 - DNA, 582 bp, Homo sapiens
  Payload ID: 6329
  Gene Symbol: FLII
  Gene Name: flightless I actin binding protein
  ENST ID: ENST00000581349
  CDS Start-End: 184-582
agttttgtcctggccctcctggggcccagaatccagtaggagagacaaatcttaggccaacacttttgtcacgggggggcttaaaattcccattctatgggtgaagaaattgaggcacaatgatgaaatgacttgtctgtgttctcacagatgggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctggtgctgaacctcagccacaacagcatcgacaccatccccaaccagctcttcatcaacctcactgacctactatacctggacctcagcgagaaccgcctggag

SEQ ID NO: 134771 - DNA, 585 bp, Homo sapiens
  Payload ID: 6329
  Gene Symbol: FLII
  Gene Name: flightless I actin binding protein
  ENST ID: ENST00000473425
  CDS Start-End: 288-585
agttttgtcctggccctcctggggcccagaatccagtaggagagacaaatcttaggccaacacttttgtcacgggggggcttaaaattcccattctatgggtgaagaaattgaggcacaatgatgaaatgacttgtctgtgttctcacagatggtgagagttggttctgtggctccccaaaggctcccatgggctggaggagccatagaaggtggtgagcaggggctctgtgcttcaccttgacatccttcccccagggcggctacttccctgagaatgtcaaggccatgaccagcctgcggtggctgaagctgaaccgcactggcctctgctacctgcccgaggagctggccgccctgcagaagctggaacacttgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagccacaaccagctgacagagtgcccgcgggagctggagaacgccaagaacatgctgg

SEQ ID NO: 134772 - DNA, 926 bp, Homo sapiens
  Payload ID: 6329
  Gene Symbol: FLII
  Gene Name: flightless I actin binding protein
  ENST ID: ENST00000577398
  CDS Start-End: 1-624
gttccctttgagagtgaggacaaccagggcatcgtgtatgcctgggtgggccgggcatcagaccctgacgaagccaagttggcagaagacatcctgaacaccatgtttgacacctcctacagcaagcaggttatcaacgaaggtgaggagcctgagaacttcttctgggtgggcattggggcacagaagccctatgatgacgatgccgagtacatgaaacacacacgtctcttccggtgctccaacgagaagggctactttgcagtgactgagaaatgctccgacttttgccaagatgacctggcagatgatgacatcatgttgctagacaatggccaagaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaa

SEQ ID NO: 134773 - DNA, 156 bp, Homo sapiens
  Payload ID: 6329
  Gene Symbol: FLII
  Gene Name: flightless I actin binding protein
  ENST ID: ENST00000628188
  CDS Start-End: 1-156
atggaggccaccggggtgctgccgttcgtgcgtggcgtggacctcagcggcaacgacttcaagatggtgagagttggttctgtggctccccaaaggctcccatgggctggaggagccatagaaggtggtgagcaggggctctgtgcttcaccttga

SEQ ID NO: 134774 - DNA, 1912 bp, Homo sapiens
  Payload ID: 6330
  Gene Symbol: FLOT1
  Gene Name: flotillin 1
  Uniprot ID: O75955
  ENST ID: ENST00000376389
  CDS Start-End: 222-1505
ggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 134775 - DNA, 1912 bp, Homo sapiens; identical to SEQ ID NO: 134774
  Payload ID: 6330
  Gene Symbol: FLOT1
  Gene Name: flotillin 1
  Uniprot ID: O75955
  ENST ID: ENST00000383382
  CDS Start-End: 222-1505

SEQ ID NO: 134776 - DNA, 1912 bp, Homo sapiens; identical to SEQ ID NO: 134774
  Payload ID: 6330
  Gene Symbol: FLOT1
  Gene Name: flotillin 1
  Uniprot ID: O75955
  ENST ID: ENST00000383562
  CDS Start-End: 222-1505

SEQ ID NO: 134777 - DNA, 856 bp, Homo sapiens
  Payload ID: 6330
  Gene Symbol: FLOT1
  Gene Name: flotillin 1
  ENST ID: ENST00000445669
  CDS Start-End: 141-856
gatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 134778 - DNA, 182 bp, Homo sapiens
  Payload ID: 6330
  Gene Symbol: FLOT1
  Gene Name: flotillin 1
  ENST ID: ENST00000445395
  CDS Start-End: 1-182
gtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 134779 - DNA, 246 bp, Homo sapiens
  Payload ID: 6330
  Gene Symbol: FLOT1
  Gene Name: flotillin 1
  ENST ID: ENST00000439396
  CDS Start-End: 1-246
gactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagctt

SEQ ID NO: 134780 - DNA, 581 bp, Homo sapiens
  Payload ID: 6330
  Gene Symbol: FLOT1
  Gene Name: flotillin 1
  ENST ID: ENST00000431966
  CDS Start-End: 141-581
gatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 134781 - DNA, 1912 bp, Homo sapiens; identical to SEQ ID NO: 134774
  Payload ID: 6330
  Gene Symbol: FLOT1
  Gene Name: flotillin 1
  Uniprot ID: O75955
  ENST ID: ENST00000444632
  CDS Start-End: 222-1505

SEQ ID NO: 134782 - DNA, 592 bp, Homo sapiens
  Payload ID: 6330
  Gene Symbol: FLOT1
  Gene Name: flotillin 1
  ENST ID: ENST00000411944
  CDS Start-End: 15-592
ctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagat

SEQ ID NO: 134783 - DNA, 457 bp, Homo sapiens
  Payload ID: 6330
  Gene Symbol: FLOT1
  Gene Name: flotillin 1
  ENST ID: ENST00000455034
  CDS Start-End: 23-457
agggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagctt

SEQ ID NO: 134784 - DNA, 629 bp, Homo sapiens
  Payload ID: 6330
  Gene Symbol: FLOT1
  Gene Name: flotillin 1
  ENST ID: ENST00000428438
  CDS Start-End: 73-629
gagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagaga

SEQ ID NO: 134785 - DNA, 717 bp, Homo sapiens
  Payload ID: 6330
  Gene Symbol: FLOT1
  Gene Name: flotillin 1
  ENST ID: ENST00000430384
  CDS Start-End: 88-717
gaaaggatgggcccctgtggacgccacagcgcgccttccccatccgcaaaggctttccctccctctcctccagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 134786 - DNA, 792 bp, Homo sapiens
  Payload ID: 6330
  Gene Symbol: FLOT1
  Gene Name: flotillin 1
  ENST ID: ENST00000421565
  CDS Start-End: 88-792
gaaaggatgggcccctgtggacgccacagcgcgccttccccatccgcaaaggctttccctccctctcctccagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgac

SEQ ID NO: 134787 - DNA, 629 bp, Homo sapiens; identical to SEQ ID NO: 134784
  Payload ID: 6330
  Gene Symbol: FLOT1
  Gene Name: flotillin 1
  ENST ID: ENST00000454845
  CDS Start-End: 73-629

SEQ ID NO: 134788 - DNA, 1912 bp, Homo sapiens; identical to SEQ ID NO: 134774
  Payload ID: 6330
  Gene Symbol: FLOT1
  Gene Name: flotillin 1
  Uniprot ID: O75955
  ENST ID: ENST00000436822
  CDS Start-End: 222-1505

SEQ ID NO: 134789 - DNA, 592 bp, Homo sapiens; identical to SEQ ID NO: 134782
  Payload ID: 6330
  Gene Symbol: FLOT1
  Gene Name: flotillin 1
  ENST ID: ENST00000416389
  CDS Start-End: 15-592

SEQ ID NO: 134790 - DNA, 592 bp, Homo sapiens; identical to SEQ ID NO: 134782
  Payload ID: 6330
  Gene Symbol: FLOT1
  Gene Name: flotillin 1
  ENST ID: ENST00000445319
  CDS Start-End: 15-592

SEQ ID NO: 134791 - DNA, 547 bp, Homo sapiens
  Payload ID: 6330
  Gene Symbol: FLOT1
  Gene Name: flotillin 1
  ENST ID: ENST00000432428
  CDS Start-End: 1-547
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagc

SEQ ID NO: 134792 - DNA, 416 bp, Homo sapiens
  Payload ID: 6330
  Gene Symbol: FLOT1
  Gene Name: flotillin 1
  ENST ID: ENST00000422714
  CDS Start-End: 1-416
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagat

SEQ ID NO: 134793 - DNA, 888 bp, Homo sapiens
  Payload ID: 6330
  Gene Symbol: FLOT1
  Gene Name: flotillin 1
  ENST ID: ENST00000442932
  CDS Start-End: 132-888
tggggctgccgagaagcagggagagaggggaaaggtctgcaggcctctgggcgcgggggacctttatcaaagggagcggcgaggggaagggagggaccatacgcaggcggagaagagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagc

SEQ ID NO: 134794 - DNA, 888 bp, Homo sapiens; identical to SEQ ID NO: 134793
  Payload ID: 6330
  Gene Symbol: FLOT1
  Gene Name: flotillin 1
  ENST ID: ENST00000439376
  CDS Start-End: 132-888

SEQ ID NO: 134795 - DNA, 678 bp, Homo sapiens
  Payload ID: 6330
  Gene Symbol: FLOT1
  Gene Name: flotillin 1
  ENST ID: ENST00000420604
  CDS Start-End: 1-271
ggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 134796 - DNA, 856 bp, Homo sapiens; identical to SEQ ID NO: 134777
  Payload ID: 6330
  Gene Symbol: FLOT1
  Gene Name: flotillin 1
  ENST ID: ENST00000413165
  CDS Start-End: 141-856

SEQ ID NO: 134797 - DNA, 792 bp, Homo sapiens; identical to SEQ ID NO: 134786
  Payload ID: 6330
  Gene Symbol: FLOT1
  Gene Name: flotillin 1
  ENST ID: ENST00000436197
  CDS Start-End: 88-792

SEQ ID NO: 134798 - DNA, 856 bp, Homo sapiens; identical to SEQ ID NO: 134777
  Payload ID: 6330
  Gene Symbol: FLOT1
  Gene Name: flotillin 1
  ENST ID: ENST00000444497
  CDS Start-End: 141-856

SEQ ID NO: 134799 - DNA, 592 bp, Homo sapiens; identical to SEQ ID NO: 134782
  Payload ID: 6330
  Gene Symbol: FLOT1
  Gene Name: flotillin 1
  ENST ID: ENST00000411848
  CDS Start-End: 15-592

SEQ ID NO: 134800 - DNA, 347 bp, Homo sapiens
  Payload ID: 6330
  Gene Symbol: FLOT1
  Gene Name: flotillin 1
  ENST ID: ENST00000436025
  CDS Start-End: 1-347
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagaga

SEQ ID NO: 134801 - DNA, 792 bp, Homo sapiens; identical to SEQ ID NO: 134786
  Payload ID: 6330
  Gene Symbol: FLOT1
  Gene Name: flotillin 1
  ENST ID: ENST00000445853
  CDS Start-End: 88-792

SEQ ID NO: 134802 - DNA, 495 bp, Homo sapiens
  Payload ID: 6330
  Gene Symbol: FLOT1
  Gene Name: flotillin 1
  ENST ID: ENST00000437093
  CDS Start-End: 1-495
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgac

SEQ ID NO: 134803 - DNA, 629 bp, Homo sapiens; identical to SEQ ID NO: 134784
  Payload ID: 6330
  Gene Symbol: FLOT1
  Gene Name: flotillin 1
  ENST ID: ENST00000444068
  CDS Start-End: 73-629

SEQ ID NO: 134804 - DNA, 888 bp, Homo sapiens; identical to SEQ ID NO: 134793
  Payload ID: 6330
  Gene Symbol: FLOT1
  Gene Name: flotillin 1
  ENST ID: ENST00000438162
  CDS Start-End: 132-888

SEQ ID NO: 134805 - DNA, 629 bp, Homo sapiens; identical to SEQ ID NO: 134784
  Payload ID: 6330
  Gene Symbol: FLOT1
  Gene Name: flotillin 1
  ENST ID: ENST00000439743
  CDS Start-End: 73-629

SEQ ID NO: 134806 - DNA, 34 bp, Homo sapiens
  Payload ID: 6330
  Gene Symbol: FLOT1
  Gene Name: flotillin 1
  ENST ID: ENST00000446416
  CDS Start-End: 1-34
gtggccaagactaagcagcagattgaggagcagc

SEQ ID NO: 134807 - DNA, 792 bp, Homo sapiens; identical to SEQ ID NO: 134786
  Payload ID: 6330
  Gene Symbol: FLOT1
  Gene Name: flotillin 1
  ENST ID: ENST00000445383
  CDS Start-End: 88-792

SEQ ID NO: 134808 - DNA, 761 bp, Homo sapiens
  Payload ID: 6330
  Gene Symbol: FLOT1
  Gene Name: flotillin 1
  ENST ID: ENST00000457733
  CDS Start-End: 132-761
tggggctgccgagaagcagggagagaggggaaaggtctgcaggcctctgggcgcgggggacctttatcaaagggagcggcgaggggaagggagggaccatacgcaggcggagaagagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 134809 - DNA, 457 bp, Homo sapiens; identical to SEQ ID NO: 134783
  Payload ID: 6330
  Gene Symbol: FLOT1
  Gene Name: flotillin 1
  ENST ID: ENST00000418160
  CDS Start-End: 23-457

SEQ ID NO: 134810 - DNA, 367 bp, Homo sapiens
  Payload ID: 6330
  Gene Symbol: FLOT1
  Gene Name: flotillin 1
  ENST ID: ENST00000426417
  CDS Start-End: 23-367
agggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 134811 - DNA, 592 bp, Homo sapiens; identical to SEQ ID NO: 134782
  Payload ID: 6330
  Gene Symbol: FLOT1
  Gene Name: flotillin 1
  ENST ID: ENST00000458306
  CDS Start-End: 15-592

SEQ ID NO: 134812 - DNA, 629 bp, Homo sapiens; identical to SEQ ID NO: 134784
  Payload ID: 6330
  Gene Symbol: FLOT1
  Gene Name: flotillin 1
  ENST ID: ENST00000424683
  CDS Start-End: 73-629

SEQ ID NO: 134813 - DNA, 851 bp, Homo sapiens
  Payload ID: 6330
  Gene Symbol: FLOT1
  Gene Name: flotillin 1
  ENST ID: ENST00000430843
  CDS Start-End: 222-851
ggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggcc

SEQ ID NO: 134814 - DNA, 457 bp, Homo sapiens; identical to SEQ ID NO: 134783
  Payload ID: 6330
  Gene Symbol: FLOT1
  Gene Name: flotillin 1
  ENST ID: ENST00000427784
  CDS Start-End: 23-457

SEQ ID NO: 134815 - DNA, 1481 bp, Homo sapiens
  Payload ID: 6330
  Gene Symbol: FLOT1
  Gene Name: flotillin 1
  ENST ID: ENST00000446072
  CDS Start-End: 1-1074
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 134816 - DNA, 888 bp, Homo sapiens; identical to SEQ ID NO: 134793
  Payload ID: 6330
  Gene Symbol: FLOT1
  Gene Name: flotillin 1
  ENST ID: ENST00000454249
  CDS Start-End: 132-888

SEQ ID NO: 134817 - DNA, 592 bp, Homo sapiens; identical to SEQ ID NO: 134782
  Payload ID: 6330
  Gene Symbol: FLOT1
  Gene Name: flotillin 1
  ENST ID: ENST00000416018
  CDS Start-End: 15-592

SEQ ID NO: 134818 - DNA, 629 bp, Homo sapiens; identical to SEQ ID NO: 134784
  Payload ID: 6330
  Gene Symbol: FLOT1
  Gene Name: flotillin 1
  ENST ID: ENST00000456844
  CDS Start-End: 73-629

SEQ ID NO: 134819 - DNA, 792 bp, Homo sapiens; identical to SEQ ID NO: 134786
  Payload ID: 6330
  Gene Symbol: FLOT1
  Gene Name: flotillin 1
  ENST ID: ENST00000454773
  CDS Start-End: 88-792

SEQ ID NO: 134820 - DNA, 457 bp, Homo sapiens; identical to SEQ ID NO: 134783
  Payload ID: 6330
  Gene Symbol: FLOT1
  Gene Name: flotillin 1
  ENST ID: ENST00000438134
  CDS Start-End: 23-457

SEQ ID NO: 134821 - DNA, 856 bp, Homo sapiens; identical to SEQ ID NO: 134777
  Payload ID: 6330
  Gene Symbol: FLOT1
  Gene Name: flotillin 1
  ENST ID: ENST00000456042
  CDS Start-End: 141-856

SEQ ID NO: 134822 - DNA, 695 bp, Homo sapiens
  Payload ID: 6330
  Gene Symbol: FLOT1
  Gene Name: flotillin 1
  ENST ID: ENST00000457133
  CDS Start-End: 1-695
gtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaa

SEQ ID NO: 134823 - DNA, 968 bp, Homo sapiens
  Payload ID: 6330
  Gene Symbol: FLOT1
  Gene Name: flotillin 1
  ENST ID: ENST00000427701
  CDS Start-End: 1-561
gtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaa

SEQ ID NO: 134824 - DNA, 457 bp, Homo sapiens; identical to SEQ ID NO: 134783
  Payload ID: 6330
  Gene Symbol: FLOT1
  Gene Name: flotillin 1
  ENST ID: ENST00000411778
  CDS Start-End: 23-457

SEQ ID NO: 134825 - DNA, 856 bp, Homo sapiens; identical to SEQ ID NO: 134777
  Payload ID: 6330
  Gene Symbol: FLOT1
  Gene Name: flotillin 1
  ENST ID: ENST00000422636
  CDS Start-End: 141-856

SEQ ID NO: 134826 - DNA, 888 bp, Homo sapiens; identical to SEQ ID NO: 134793
  Payload ID: 6330
  Gene Symbol: FLOT1
  Gene Name: flotillin 1
  ENST ID: ENST00000431913
  CDS Start-End: 132-888

SEQ ID NO: 134827 - DNA, 2756 bp, Homo sapiens
  Payload ID: 6331
  Gene Symbol: FLOT2
  Gene Name: flotillin 2
  ENST ID: ENST00000394906
  CDS Start-End: 79-1530
gggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggtcccttgcccttgcctattggactgcaagtggggaaacagcaagggattctggaagctctgccaagtctgccagatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccc

SEQ ID NO: 134828 - DNA, 2618 bp, Homo sapiens
  Payload ID: 6331
  Gene Symbol: FLOT2
  Gene Name: flotillin 2
  Uniprot ID: Q14254
  ENST ID: ENST00000394908
  CDS Start-End: 106-1392
cggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacccc

SEQ ID NO: 134829 - DNA, 2679 bp, Homo sapiens
  Payload ID: 6331
  Gene Symbol: FLOT2
  Gene Name: flotillin 2
  ENST ID: ENST00000580805
  CDS Start-End: 80-436
tgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 134830 - DNA, 2585 bp, Homo sapiens
  Payload ID: 6331
  Gene Symbol: FLOT2
  Gene Name: flotillin 2
  ENST ID: ENST00000585169
  CDS Start-End: 79-1365
gggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcc

SEQ ID NO: 134831 - DNA, 1069 bp, Homo sapiens
  Payload ID: 6331
  Gene Symbol: FLOT2
  Gene Name: flotillin 2
  ENST ID: ENST00000586827
  CDS Start-End: 15-221
gtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggcca

SEQ ID NO: 134832 - DNA, 746 bp, Homo sapiens
  Payload ID: 6331
  Gene Symbol: FLOT2
  Gene Name: flotillin 2
  ENST ID: ENST00000465427
  CDS Start-End: 1-746
actgtctctggaggttatgaccatcctgtgtcgctgtgagaatattgagacgtcggagggggttccactattcgtaacaggggttgcacaggtgaagatcatgacggagaaggaactcctggccgtggcttgtgagcagtttctggggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagagg

SEQ ID NO: 134833 - DNA, 2660 bp, Homo sapiens
  Payload ID: 6332
  Gene Symbol: FIZ1
  Gene Name: FLT3-interacting zinc finger 1
  Uniprot ID: Q96SL8
  ENST ID: ENST00000221665
  CDS Start-End: 91-1581
gggtggaagtgacgctgcccccgctgcccaaaatgtcggcgcccagagggaggtagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgcggcctccttgcccccatttgcgtgcggcgcctgcgcgcggcgcttcgaccacggccgcgagctggcggcccactgggcggcgcacaccgacgtgaagcccttcaagtgcccgcgctgcgagcgcgacttcaacgcgcccgcgctgctggagcggcacaagctgacgcacgacctgcagggcccgggcgcgcccccagcgcaggcctgggccgcggggccaggcgcagggcccgagacggcgggcgaaggcaccgctgcggaggcgggcgacgctcctctggcttcggaccgcaggctgctcctgggccccgcggggggcggcgtgcccaagctcggggggctgctccccgagggcggtggggaggcgcctgcacctgcggcggccgccgagccctcggaagacaccctgtaccagtgcgactgcgggaccttctttgcgtcggccgcggccctggccagtcacctggaggcccactcgggcccggccacctacggctgcggccactgcggggctctgtacgcggcgctggccgccttggaggagcaccggcgggtcagccacggtgagggcggcggggaggaggcggcgaccgccgcccgggaaagggaaccggcgtccggggaacccccgtctggctccggccgcggcaagaagatcttcggctgctccgagtgcgagaagctgttccgctcaccgcgagacctggagcggcacgtgctggtgcacactggcgagaagccgttcccgtgcctggagtgcggcaagttcttccgccacgagtgctacctcaagcgccaccggctgctgcacggcaccgagcggcccttcccttgccacatctgcggcaagggcttcatcacgctcagcaacctctccaggcacctgaagctgcaccggggcatggactgactgccaggctgcgtgcgccctgccctccacccagcctcctggactcggcctggaccaggggacctcgggactgcgcgtgaggccccggccctccaaatccaaatccagacgcaggccctgaaatgaggggaccctgactggagaggtgggggccaccaaaaacccacaaaggccccggagctgggggaccacaaacaaacagggtccttagctggggcaggggagcccaaatctagggagagactcctgagcctgaggtccctggaatgagtgtgggtagccgtaagtccccaagacatggggactttgcagtgagcaatgggtctccacaagtacctctcatcttgagagccctaatactaaaagatgggcacccacccccaccaagggaagactgccccattccctgagagccatcattcctaacgaccttgatctggagaatgtggagggagcatgtccctgaattttcctagatccctccaaatgccacccaccagagtcactggtgaccccagaaaatggatatagccgaaatctgcctttcccctttttcattccctgtgctgaaagagggaccagggtagatgccccctgccctcgaatcccccctccccgactgtggaatggatcgaccctaacgatcttccccgccccaaacactagaatagactggcctgaaatccccttgcccagtagaatggactgatctatgtgcacacacccccatcacatggaatgggctggtctaggctgtggcctgccaccttccttagagtgaatagggcggacactcctctcttttcctgtagcgtgtggaccggtccacgcaattctttatcctgtgaactcatctgagtgggaggtggtggacactggggtttccttccctctctccgtagcatccgttggtctttctctccatctctgttggtttgtctgtctctgtcttcctcccaatccctaggggaagggggcatttggctagggggtgcccctgtgagcctcgaccttgccccctcgtccctctccccagtgtttccaggacccccaataaaccttgtcctgtcagtcgctga

SEQ ID NO: 134834 - DNA, 4686 bp, Homo sapiens
  Payload ID: 6332
  Gene Symbol: FIZ1
  Gene Name: FLT3-interacting zinc finger 1
  ENST ID: ENST00000590714
  CDS Start-End: 4106-4686
gtttgacattcatccagatacacaattttagctatgctggtgggtaaaacagtgagatgatcttgtatcagctgataaacaggcacttccctgagctccaccagacatccctatgcctccctaactctccttctggatctagaagttcaagatcaacatgagcaacacccctccccacctccccacaaaaaaaaaccttccagagaggatagagtccaactgagagtgcagaccagtattgtgatccttgaaacggagagcccatcaaactccagagccatagaggcctcacgaatgctctcatccctccctgctgactggcagaagtggggaaggggttccagagtggaaaaaagggactggtcccaggtgatatttgaccctgattcctggatgaggaaacatatctgcgatgttaagagcctgggccctggagtcaagacatcattcgttcaaatctttactctctgcgtggccttgggcaaggtgttcgcttctctaagccttaatcaagacttttgcaaaatgggacacatagttctacgtacttgcccagacatgccatgagcataatacccacaaagtgttcatacacagaagctttcaggacacattagccattgttatcaggagcagctaagcctcacatcaaccctctgaatagggcatatctgtcccattttgcagatggggaaactgaggcacaggaaagccaagtcagttgcctaagttcctctgccagtaaatggcagggccaaaactggaaacaggtcttgtgacccgaatgtcccagagaatggagaacaaataaacccaaggaggaaaggggacattacgagggctcagtcctgggtttgaattcagctctgcctataactagcaattgactttgccagtttcctcctctgaaaagtgaataaaccagggttgtcaggagaatcgaataagacagtgggctttaaaatgcccctcgaacactgcctggtgcacagtaagcactcaataaacttcaccaacgccaccaccatcttcccggcgcccactcagatactgggagcatgggattggggtgtaacggaggggaaggggaggcacaggtgcagctggaagcaggtgctgcaggtgcccccctgcacccccccctcccctttaacagccacatagactgctgtccagagaggagcaaccacctttccatacggttcgctcccacggggtagcctagtctaggagtctggtctttggaacggtggaaagggggagactggtcccccgaccctccccgtcccctcgccccggtactgacgcgcccatcggcccccgagctgcgaagcccaagcgcggggcgggccctgcgggggcgacggccaatgagcggcgccgggtaagcgggcggcgggggctgccaggaagggggtctgcgcgcgcgcgcccggacggcttcgcggggcgcgagcgcgggagcaggaacaggtgttggaggcgcgctccgggagcgcgcggcccggcctcccctacccccacaccccccctcccgcctgcgccccccgcctctcgggtacctcatttgcatgtcgccggggctcgcgagtgtgcgcgcgcgcgggggcaacggggccggcgcgtgggaaggggagggggtgagggggccctgcccctcggcggcggcgaggcgggggcggcggcgcgcggtgccggccccgcccctcggagaagcgccgggcccctcccttcctgcccttcccgcccgcctgcgcgcccgcgggaaacaaaggggactcgctgggtcctaacgaccggtcgcggccacgcccggaagccgcgcctgcgcaccggcggccctggtgtgtccccagtgggaaataacccagcaccacatccccaaccacctcgaaacgcctttcctctcacaaagcccacagtcgggtgacccaaagacagataccgaatgatgaggagcgggaaaatggctgcccagtgcccgtaattaacatggcaccggacaggcttcgaagcccatggagtgctaagtggataagatggtgccggtcttttccagctctgtattgcagttggcgcacttcgctttctttttttttccctagtccaactgtacatcctaatcggaggagtccgaggctgtgaaaaagaaatagtatctgctctcatttacgttagcatcgcctagtgtcgccacggagaagccccctcgctctcagctccttgcccttagtctgtatggcgccgtgggtgtccctaagccccgccccttcccgctgccctcacccaagatggcgcgggcctggcttcttcaacctccagggctgggaaaggaaagggaaagagggagaagggcggggatgaggaaggggagccaagagggcgggagaaagggggagtacggcgggggaagggagctgaggcggaagtcgaggggccccccgggtggaagtgacgctgcccccgctgcccaaaatgtcggcgcccagagggaggtgtaagtaattaaagaggaaagccgacggacttccccggcctcccggggccgccccgggtctccaggaccaacgctccgtacgagcgaggtggactcgcctggccccggggcctgcccgacctgccccccaaccgggcgcccagggctgcaccttttaggggcagggggaggggcacaaaaggccggctctcggggcctggggcctggagcagactgggcaagtgggggggcccgctcctcaggctgcggggtggaggaggaggcggggcctagtggctgctggggcggagcaagggctgggaggagcctgagttgggcggagcttagagtggaagtgggaggggcgtggaggagggagagtctggatagaaaatgggagggtcttaggcaaagaggtggggtttgataaaggggcgtggctcagaaggaatggtgggtaggccctggattgaggggtggaaggaaactcattgaggctggttgggtaaagggagcccaggaagcaggagggaggagtttagagtagaagggatggagtttgtctggggtgtggcttagagaagtaggtaggcctagtgaggggggtggagtttaagggtgtaatttggaggggtttaatgcaactatcaggtctttataatgaatgtggaaaggacttgcaggggatgggaatagacttcgtagagaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtgggcacgtagcatttattgccacaattttacttaattctcgccaccactccatgaggtaggtactactattcccattttacagatgaagaatttttattatctgatgttacaggagtaattctggtctccctgcaaggatgactccagtgtgcttagccccaaatctttgccctcccattcgctaagtggtcatcctggaagaggagtgggaggagcttagaggggagtgggagggccttttggaaggaaaagggcttggcaaagaatacaagatccttagggaacattgtgggggactttgaagggagtaggtgggacttaaggaagagtgggagaggcttaaattacagtgggaggggcacagagagcagtggccgcgcattggcgaagagcgaggagaggcttaaaaacactccgtggagtgaggagactatgaagtgattaggaagattttgccacaggcgtggagccgcgagagaagggtttctaagagagtaggaggattttaaagaacaatgagagtggcttagagaggtgggcagtgggagggtctcccaggggacaggtggtgggtctgggaacctgggaggagagagctgatggggagccgaccccctcacctgctcctctgtctccccactactccagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggcaggcgcgggtctgggcagctgggggctggcagaggcggcagctgcggccgc

SEQ ID NO: 134835 - DNA, 462 bp, Homo sapiens
  Payload ID: 6332
  Gene Symbol: FIZ1
  Gene Name: FLT3-interacting zinc finger 1
  ENST ID: ENST00000587414
  CDS Start-End: 331-462
gaaggcctgagaaggtgacgggagtccagtggagagtcttagaaaggatgtggcttctttaaaggaaaaattgggtggagttttggaagtgggtcttagtggacccgagaggggcttagataagtcaaataacttagcaatcatggtaggacttaaggaggaatccaggaggaacttacgggataatagtcatccaaacagcttacttgttgcgtctttgctgtgcaccagcttaagtgggcacgtagcatttattgccacaattttacttaattctcgccaccactccatgagagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccgg

SEQ ID NO: 134836 - DNA, 600 bp, Homo sapiens
  Payload ID: 6332
  Gene Symbol: FIZ1
  Gene Name: FLT3-interacting zinc finger 1
  ENST ID: ENST00000587678
  CDS Start-End: 1-403
ccctgcaccagcaccgcccgccgctgccgcccccagggtcccgtttcactgcagtgaatgtggcaagagcttccgctaccgctcagacctgcggcgccactttgcccggcacacagcgctcaagccccacgcatgtccgcgctgcggcaagggtttcaagcacagcttcaacctagccaaccacctgcgctcgcacaccggggagcggccctaccgctgctctgcctgccccaaggggttccgcgactccaccggcctgctgcaccaccaggaagcaaagcaggctttggaggaactggaggaaggccaatgtgactggagcatggagaagcagaaagtgtggctcaggagaagtctggagagtgccggaccctggaaatacagctgtcgtccacactggtgagaaaccctactgctgcctggtctgcgagctccgcttctcctcacgctccagcctgggccgccacctcaagcgccagcaccgtggggttctcccctctcccctgcagcccggccctggcctgcccgccttgagtgcgccctgctccgtctgctgcaatgtggggccctgctcggtgtgcgggggctcaggggccggcg

SEQ ID NO: 134837 - DNA, 489 bp, Homo sapiens
  Payload ID: 6332
  Gene Symbol: FIZ1
  Gene Name: FLT3-interacting zinc finger 1
  ENST ID: ENST00000592585
  CDS Start-End: 194-400
aaagagggagaagggcggggatgaggaaggggagccaagagggcgggagaaagggggagtacggcgggggaagggagctgaggcggaagtcgaggggccccccgggtggaagtgacgctgcccccgctgcccaaaatgtcggcgcccagagggaggtagagagcccccacataccactgtattccccgccaccatggatgacgtccccgccccaacccctgcaccagcaccgcccgccgctgccgcccccagggtcccgtttcactgcagtgaatgtggcaagagcttccgctaccgctcagacctgcggcgccactttgcccggcacacagcgctcaacgccagcaccgtggggttctcccctctcccctgcagcccggccctggcctgcccgccttgagtgcgccctgctccgtctgctgcaatgtggggccctgctcggtgtgcgggggctcaggggccggcggcggagagggccccgagggggca

SEQ ID NO: 134838 - DNA, 915 bp, Homo sapiens
  Payload ID: 6333
  Gene Symbol: FLYWCH2
  Gene Name: FLYWCH family member 2
  Uniprot ID: Q96CP2
  ENST ID: ENST00000293981
  CDS Start-End: 260-682
ccagaagacagggcacccgcggccttgctgcgcatgctcgcgctgtgaccccggcttgaggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgcttttaacattgtgtgatttcttttctttttttttttttttttagatcaagtataagttacttttgtaagcagaaaaatactttcaaacaagaataaaagaagctgttcgctagaccccataatgggcaggttttaaaca

SEQ ID NO: 134839 - DNA, 1036 bp, Homo sapiens
  Payload ID: 6333
  Gene Symbol: FLYWCH2
  Gene Name: FLYWCH family member 2
  Uniprot ID: Q96CP2
  ENST ID: ENST00000396958
  CDS Start-End: 381-803
gggcaagacgcggaggagcggccccagccagaagacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgcttttaacattgtgtgatttcttttctttttttttttttttttagatcaagtataagttacttttgtaagcagaaaaatactttcaaacaagaataaaagaagctgttcgctagaccccataatgggcaggttttaaaca

SEQ ID NO: 134840 - DNA, 754 bp, Homo sapiens
  Payload ID: 6333
  Gene Symbol: FLYWCH2
  Gene Name: FLYWCH family member 2
  ENST ID: ENST00000572006
  CDS Start-End: 308-742
gaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggtgaggctccacagcggccccccaggacagctcggcacctcccagggtggcccccacagccgcgctggctccatcaggcgcttctccctggcatgcgggtccttgttccctgactttgaccacgt

SEQ ID NO: 134841 - DNA, 511 bp, Homo sapiens
  Payload ID: 6333
  Gene Symbol: FLYWCH2
  Gene Name: FLYWCH family member 2
  ENST ID: ENST00000573965
  CDS Start-End: 238-511
cccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattg

SEQ ID NO: 134842 - DNA, 5037 bp, Homo sapiens
  Payload ID: 6334
  Gene Symbol: FLYWCH1
  Gene Name: FLYWCH-type zinc finger 1
  Uniprot ID: Q4VC44
  ENST ID: ENST00000253928
  CDS Start-End: 406-2556
gcgcgcctgagcgttccgcaaggccggctccccggcggggtcgcgcgcgcggtcacggggctcgctcccgaggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatcagaaacgta

SEQ ID NO: 134843 - DNA, 2565 bp, Homo sapiens
  Payload ID: 6334
  Gene Symbol: FLYWCH1
  Gene Name: FLYWCH-type zinc finger 1
  ENST ID: ENST00000344592
  CDS Start-End: 1-1483
gttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggcgctggcctctctttccagtggctcttccggatcctgcagcttttgggtcatgctcctgtgctgctgtgcccctcagggtcctcctgcctcccgagcctccctgctccacatggcccctgcccagccctctccatccctcttgaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatc

SEQ ID NO: 134844 - DNA, 4963 bp, Homo sapiens
  Payload ID: 6334
  Gene Symbol: FLYWCH1
  Gene Name: FLYWCH-type zinc finger 1
  Uniprot ID: Q4VC44
  ENST ID: ENST00000416288
  CDS Start-End: 344-2491
cgctcccgaggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatc

SEQ ID NO: 134845 - DNA, 721 bp, Homo sapiens
  Payload ID: 6334
  Gene Symbol: FLYWCH1
  Gene Name: FLYWCH-type zinc finger 1
  ENST ID: ENST00000570425
  CDS Start-End: 581-721
aggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcgtgctactggcgggacgtgtggaaggaacaaggctgaggttggggctagattgcggagtgtttatgacgcccagctgatgatgcactaaggctggagatggagatgatttaattggggagagacatgctgaaagttaagctttaggaagagtgacctgtcagcaccctatgtggagaattggagtggctgcttgccaaagctggcaagatcgttcagaggctttggcttgggctaaagaggtcgtggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcc

SEQ ID NO: 134846 - DNA, 1470 bp, Homo sapiens
  Payload ID: 6334
  Gene Symbol: FLYWCH1
  Gene Name: FLYWCH-type zinc finger 1
  ENST ID: ENST00000573564
  CDS Start-End: 1-1403
agccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatgggtaattgtatttgttatctaatggtgcatgaccaattacaacaaaacgtagtgggcttaaaacaacaaata

SEQ ID NO: 134847 - DNA, 404 bp, Homo sapiens
  Payload ID: 6334
  Gene Symbol: FLYWCH1
  Gene Name: FLYWCH-type zinc finger 1
  ENST ID: ENST00000571983
  CDS Start-End: 1-235
ccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggtaaatcccagccactagtatgatggtaggctaagtcctgtgagtccctcaagtgcagtcaccaagcctagtgtgtgatggggatgcctgcataccagatcagtagagaaaaggacaaaaaccgtgtgatcactgaatagacacaaaacatttgacaacctccaacacgctttcatgataaaaacattcaac

SEQ ID NO: 134848 - DNA, 643 bp, Homo sapiens
  Payload ID: 6334
  Gene Symbol: FLYWCH1
  Gene Name: FLYWCH-type zinc finger 1
  ENST ID: ENST00000573525
  CDS Start-End: 413-643
gggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggctggaacccgtggtgacctcagaattctccagacaccaccacagccccgtccccgaccagccgaggcagccacagcaacagctccggcacaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgcc

SEQ ID NO: 134849 - DNA, 757 bp, Homo sapiens
  Payload ID: 6334
  Gene Symbol: FLYWCH1
  Gene Name: FLYWCH-type zinc finger 1
  ENST ID: ENST00000575679
  CDS Start-End: 1-280
ggccttgaggcaacgggagcggctccccaccacggcccagcaggaggacccagaaaagattcaagttcagctgtgcttcaagacgtgttctcctgaaagccagcagatttatggggacatcaaagacgtcagactggatgcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggc

SEQ ID NO: 134850 - DNA, 594 bp, Homo sapiens
  Payload ID: 6334
  Gene Symbol: FLYWCH1
  Gene Name: FLYWCH-type zinc finger 1
  ENST ID: ENST00000571580
  CDS Start-End: 1-594
ctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccagagagacagtgctgcgaggtccccgcctcgtcctcacccccgctcctgaccccacaaagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgagtgacgcagcagacactgcctccctgaaggcatggcaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcaccc

SEQ ID NO: 134851 - DNA, 3930 bp, Homo sapiens
  Payload ID: 6335
  Gene Symbol:
  Gene Name: FMN1
  ENST ID: ENST00000633316
  CDS Start-End: 468-2456
ggactggagcgcagcatccttcgaggctgcagccgccacggctgttgccgtaagcaatcctcctgcctcagcctcccgagtagctgggactcgggaccagcctcccgagtattggtcagatgacatttaccatcaccgttttcttcttctttcatcatcatcatcatcaccattgccactaccaccacctccaaggccactaccaccacagcatctctgttcctccatcagagctcttcaagttctgtaaaggcagattctctaaaggcatgcctggtggcatcacgtttttcacatctccgcatctggaccctgcccaagcgaaggctgatctaggcagtctcattgctggagatgactgtcagctgctttctctgcatagccaccatcacatgcctcaccactggagcctgggaagcctgaccacaaaccggcatctccaaggcatgaataattaggtaggcataatggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagccttccattgggatcttcagcagcactttcaggaaccagtcataagaactgtaagcatctcctgtgcttctaaccttataaaagaagaagctggaaaagggaaggagagtagaagtgggtaagagctttttttgatatgggtaacttctctactgtggagacttcctatagggcctccagccattacctcctattggccctactttgaaaggcatgagggagggagttccccagatagtacctttgatttgtatcctctgtctagttcccttttctctcttgattttccctttcctgtcgctgtgagtcctctttatattctgaacccttcagtgactccctgcagctgggaagcccatacagggagaagtttcctgcttccagctacctttgtctttcacttcatttctcttcccacctaaacccagaagagggctcagagagttgccagcagtccagaaagaggggtgaataattcatttaccatcacactacagtgtccctttatctgaacccaactcccacctttctcccaggttagctattaaccagattaagtttatggtctgtggacatttatttcctgtggaaataacatctaggtatttttattgaagtgatgtcattaagattattgaaagctctcattaactgcttaagaaagagattaagtctggcaaaagtaatcagatctgtttccagttggaagactcttcaatgttagaggcaagtagtaattcccaggaaccagtgaaacccgcttatccttgttacaagactaagcagttaaagctgacattaccattcatgcaggatgtagcataaggatgtcacagaggccagcgatgcaccttctgttgggtttgtaatttcttaacttctcatttcaaggatgatgcatgggaatctccattatcaccacatagtggtgataaaatagagaatatactaacaagaactggtagtcaggtttttcttctcctgcctcctcccaccaccaacctggagattggttttatagtattttatttggcgggtggagactgatgtggaatgttcccaagcctttgtggagtatggtcttcccccaaaccttgaggaactctagttgtgctagcctgcaaagcagtgtccttggagcttggtgctaggattcctttctgttttgcttgctttcatttacctttgattcaaagtaaacccttttagtgccagaagaatcacagggagcttggctcaccatacttgggaaatgcccaatctttagtatgctcttgagtaatcctgtggttgttttcctttgactgaagtcactgatgtggtgatggaagcatatgctccaggcatagttcttcctgatattgagaactgagaatctcttgatcaattcttgtgcccatgaaaatatgtaattaatgtcaacttattaagagttaagaggcatacatgaaataaattttatttacatgtgtaaacccctaatactactgtcaaagctttgattgtctctgtggatatacattatgggaagtaaatataaactcttcccatattaatattaaggtttgatgcaattccaataaaattgtaaagaag

SEQ ID NO: 134852 - DNA, 4251 bp, Homo sapiens
  Payload ID: 6335
  Gene Symbol:
  Gene Name: FMN1
  ENST ID: ENST00000633180
  CDS Start-End: 127-4092
ctcattgctggagatgactgtcagctgctttctctgcatagccaccatcacatgcctcaccactggagcctgggaagcctgaccacaaaccggcatctccaaggcatgaataattaggtaggcataatggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgcct

SEQ ID NO: 134853 - DNA, 12355 bp, Homo sapiens
  Payload ID: 6335
  Gene Symbol:
  Gene Name: FMN1
  ENST ID: ENST00000631811
  CDS Start-End: 1-3591
atggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgccttctttaagaagtccctcattaagccgcaggaacaatggaaaactatttaagggaacattgcagaaatatttgatgactgtttcttgtggaagcccaaagtccactctaagagcagaagaaataccaaaatgtttccaaaatttttttaaaagctgagatttccagctttataaccaaagcttgatatatgtcacattgtcacagaagagagaaaagatcattgaggacagttgccttgggagagttcaagtctttgtcgttacacactgctgttttgattattggtcttagttttgatcctgttgcagcaaaatcctgcagcatctttctctccaataatgttgcaactcaccaaaactattcttgaagaggtccaagaacatgtattatccagactaaaaaaatgattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgttgtgttgatacgcagccgagttctacgttatgtgctgtgactgtgcagctggacgacccccatccccaggaggcagtttccagacaggagagcaaatgcaactcacagcacctgctcatgaccttggctgataggcatgtgaagtaggatgaagcaggactctttaatgtcaaaaaaactgaagggcagaaaaaaggttccttacatcaaaatgaaagtaattacattaatagaaaacttccaagtggaatattgttcacaggcagctctttctgaccctggctcttgagtcacataaggaaaccacctttgacctctctgacacttttgtctttaagccacgtctctgaaatcttgtgaggggtgaagaaagaggactggagatgaatggacaatatgatcaaagactcatttttaggccttgaagaggccgagctttctccccccaattggtggaggacagtccagagatgagcagaaatcttaaattccttcctgatccagcctccacatgtggcctgccccttgccccagcatctttccagaacccctggacttgccaggtgcctgagcatcttcccaggatatgcctgccagccagcagcccctcaggaatgcttctataatagatccagtaatgaaagcagcaccatatcctaatctaatgtcagcttcgagaatgaagactgcagtcaggatcaaatcaagtcacagaagccatattcatgcaggtgctaaccgccttttctactggtgcaactgaaaggaatatggtaacatggttggatttttaaaattcacaatgaaggaacgagacaagcaaaacagaaaagccgagaaggaacatgcatgactaaaaaggcttgaagttgcttgtgagcaagaagctttttatgctgctttcttacatagtttctcttcattttcacttaactctgaagacaaccaaaagaacggatcaattaaaaactgattccacttataaccattgtatgctccttctagtgttatcatgcacaagaaaagtgccagttttacccatgccatataattcagctcttttgagttatgtggggccagcagaagtctcaatccttataggcttgatggtgagagcagcgggaggtttgaggtgtactcattgcagtccactttggtctgtaagtaggatgcttacgagaaatcagtgaaggtaagcagggctgccactgtggccacgtaacccttcaggaaccagtgctgaagaataatgagtgagaacacttaatttgagagttagacaaatacagcccactttggatttcatcctagtgaacagactaaaactttgcagtaaaatacctatttctacaaagcaaggtttgcctgcctcggttggggaaacctagtggttttgtcacactagtcgatgtatgatgttagtgttgtaagacaccatggcagaatcttcattattctcacctattctgaaccctgcatcatgtatctgggatgccccctcccaagtccaccaatgtaccacgttgctgacacagccttcatttttaactcaaattgatgctcagtaaaggtcaatgacaatttgttcaaggaagttcatctaaaataatctggaggccttgaaaatgatccctctaaaatgctgttgagcttgtgttcagtgtagcaggaggatctgaacttttcctggagaggaggtgatcgggatgccatttggcagcttaagcacatcctgccagcaggctttaagtggctgttctaggcatagccctccctgaactagaaaggagagtaaccagtttgctatgctgcatctaaccagacacacctgacttagtagtaactctaagaacccttaacttacaaacaactttgtctcctcttagacaatattcattaaatctgaggacacagtttgacagtagttcagattcttgcatgagcaattgacagcatcagagcacacaatatcataagttacataaattacacaaagtacatcataaattacactacagacacgttaggtaaaaagcatcaggcccgggccgggcgtggtggctcatgcctataatcccagcactttgggaggccaagcgggggcggatcacgaggtcaggagattgagaccatcctggctaacacggtgaaaccccatctctactaaaaatacaaaaaattagccgggcgtggtggtgggcgcctgtagtcccagctactcgggaggctgaggcaggagaatggcgtgaacccaggaggtggagcttgcagctagccgagatagcaccactgcactccagcctgggcgacagtgagactccgtttcaaaaaaaaaagcatcaggcccatgaagtatcaaaaaccaggttaggaggtgtgctgtatggcttttatctcaataagtggcagcttactggggaaaaagaaataagaaaaagtgtggccaagcagaagtggatgtttatgatgacggtgggggcccagaggtcataggtgatggtcctactgcccaacagttgccttttgaatccttatgttgatgatggtgtctttctacacactcactgcaactactcaggaattataaagattttctgaaatctgagaagtggaataaggaaacccagtggagctattacacttttaaatgttctagccaaaacaaattgccagtatggttgaggaattgaatatcagatggcatgcagtctcccctcccctcccctatcaaggacagtagaagctgcaaacctcttctcagcctccttcaggcacctcctgttttcataagcaccatgaagaatggtgtttcctaaatgaaaagttcagatactgctggtaaagaaactggaaaaactgaaggaaggaataaaatatgttggtggtattaacacctccagtaagataagtcattggtacggtttttctaagggccgcagtgagatgtagcagaagaaatatgtttattttgggcaaagatttgcttattggcctgggattgcacattttctctatgatgtttgcaacagagaaattttcattttaatgatactcttcctttcttgaaagttacatgtcctcatttctgtttctgcttctcccttggccagtgtcattgatgcagatcattgcatacaacagcacagcaaattgcgccaagtcagtgtgtgaatgggaattagcaatgcacgcttgcaggctctttttccaggaaccaggctgtaacattgaccggggaacctcttcattccctgacatactaaattggtcaattttgtagtactcatctccatccacaaaaacaacaaagataaaatcaatttggagctttatatgacaaaaaggaagaagtccaaaaatatatagccttcccccctcccacatatctgatccaaatattaaatatctgattttataaaacagtttaaattgtctttttaaattgctaacaagcatcagttatatttgagcttcatttttcttttatcctgtctgtcctaataaaaacaaaaatggccaaaaagtggagaggaaagaaaaagcttccactttttaaaatttgttttgtattagttattttacctttagggaccctacaactgaagagagtggagagaataaagaagtgaactttcattcatgtctgctactttgacctcataaagaaatctgcaacacagatgaaaccagtctgtgtggccaagctgatgggatttgaaaagagtggataatttttagcctttccaaaatgcaaataacttggatatatttccattttccagctatagagagaaacaatccagctgcctggaaactgttattagtatagaagtggcttaaagaaaagcatcttcaaatacttgacttagcatatctttcttctttagacttacataatgatattcatctctccattagcaattgaatccaggcataaccgggctcagttacacagcttgtctgtgactgggaagcccattttgtgtcatttctgcacacctgtccgctgttgacaccttattagaggcactgcattttggtttcacaattcttcatctcccttcccaaggaatgggcaatctactgaacttccagatcaatgctttgttggaaagtgatgaatttaagagagttttaacatgtcaaatttgaagccaattcagtatccttatttgttccaagactcttaaccaatactgtgatataaagttaggatttgggaaacgtgtagttaacaacttggaaacatgaagatattaaaatggcagctggctaactgtctcttaagccactatgcaatttctaccaatggagagattagggaagcaaattaagcctcattcagtaggtctgctgtctggtggaacttacggaactcatttcctcctctatccccagcccttctcctaactatggtgataaccagggccatagaagaccttttctctcttacctttctctgataggatcgtgtccttcagtcaagagctcatgtgaactccagactttatattacatctctgaagttcttgatgtggggaagattgacttttattccatttttatatgaaggtgttagatatagccatcaatttatttttctacattccctctacgcttatgtaattttctatttttaaatcttctcttaaatatactgagaatctctagtctccttttctaaaggctgatccaactacacttgtgggctatttttccaagctttgtgtgaaacttgatgacattgggccagcaaaatgcaaagaagactatagtttcaggcagaaaatcacgtccaaagaatttggcatggattaaacaacctctaccacactatagctctcacataggctgaacattttcctaaattctacctgtgcagacactgaggggctctctacctttgaaactatgagaacgtcttaaattaatatgaatatttctctccatgtatagtgtgagctgccaatgcattatcttaatacatcaagaaggaaatcagatttcaggcacacattagcaattgtttgttaatgtccttggcaaacgtgtacctgctttccttcattgttctcttcaggggctttcttccactttcctcttatgaaacgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagtgagagggaaagtctagtatcaattcttctgtttgctcgcaatgacacaaataggttttggggatctacctaagggataggtctactccaaaattattaaatttataattgtgcaattctgtaatttcccaaggcataagtaatatgaccctactgtcagctagatgtcttatcttcaaagagagtatgcattaataaaaagaacttccctttaaagaaccaatctaaaatactaaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaaggcagtcaacatcctagtatgaatcagacctagcagaaatgtaaattatttcaagtacttcagggtttagttttcttagtgacaccctggaccctggatgctgctttctaaagtgcacctgatccatgcagttttatgtcttcatataactggtatcttgtgagtttgcaagcaatgggatgagcaagaaaaaaaggacgcatggaggagaaaaatttgaacgaggctagtgcaatgttttgctgatagattacattgttagggagctggtgattttttgccatggtcgtatcgtggacagcttttccgtggaaattcaaggcatctgtattaggcaaatgtgagtgcccttgatcttgtattgatcagtgccaatgtactgggaaagcaggtaccccagtgaaactggtctgtgcttggtttaacagctccaacaatttcagatccatggggctgcttgaccatagaccctgtttactccatgcctgttcaaaagtcattttgacttctagctttgtttcactttcttctttcaatacttctgtttcctcgtccttttccttcatattccatggctatttctttcctactttacagtttcccccagacccagattttttcacacctctgcatcatagacaactgagtagctcccttggcccctcctccatcctctcacaccctgtgctccgttcctcagccgtttggacagggagctccgctgtcaccaaggagcccatgtgagacacactgctgtgactgcctcttgttaatgtcagcatcacctcatcacttaagcaaaaaggaaaatccataaaagagatggaaaatacgtctctttttattttattttaagaagattgggcggggtggggggggggttcttattctaggccttctcaatttctcatagattttaccttaaactaattaaggccattctcttgataaatttgtacatcagaccgggtcaccagctatgatgcagaacgccagatttttgaatctcaagtaactttctgtggtgctggacaaattgacttaattctgtgcaggcaaacactttgaatcataaggatttttattgccgctccattcttactactattcatgattcaaacatctacccctgttctgaatcaggatgttgacacttcttggttattttcagatgaacagtaactgctacactcttgaaagcacttaaaagtgcaagcatgtcctaaatagccatttaacctggtaaaacataggcttttctgtttaattaagtattagaccagtctgtagatataatctgaaaagattgtaggcagtaatgaagacagttggggaaaggagaaggccctttaaagacatgaaaccttacacgctcttgggatatttttaagcataataagctcattggattcaggtatttttccctttgcatttttaaaaatacgtatttctaatttgtttgcatatttaattttgtcaaagctgagaaatgctcatgagttgaatttataaatgtcatttgcaaccaaatgaagtatttatttttaaaaagagagtgaaggaaccaacactgatttgtacataataaaaatgtgtgtattatatatatatattttttcctccttgacagtacttggtcacaatatcaagtgtatttttgtacataatatatattgattagaaaaacgtcaattgtctattcaaaaaattctatctctgtgatagattatatttatcctaatctgttgatacctctgttaatttgttttaagagaattatattttttggaatttacagagaattgcattcatggctttcaattgtaaatatgctaagggtattttaataaatcttggtttcatgtc

SEQ ID NO: 134854 - DNA, 4260 bp, Homo sapiens
  Payload ID: 6335
  Gene Symbol:
  Gene Name: FMN1
  ENST ID: ENST00000631756
  CDS Start-End: 1-4260
atggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaa

SEQ ID NO: 134855 - DNA, 576 bp, Homo sapiens
  Payload ID: 6335
  Gene Symbol:
  Gene Name: FMN1
  ENST ID: ENST00000631673
  CDS Start-End: 1-175
atttttacatgagttagcccagattcctaattttgctgaacgtgcccagtgcataatcttcagatctgtcttttctgagggtatcacctccttgcacagaaaggtagagatcatcacgcgagcttctaagcaactgttaattctgttggtaccaagcctcccgacagcctattgagtacacagtcgatatttgttactgaatgaacatgggtgcatttggagttcagctccgtaataactggtgtttgccatcacaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagag

SEQ ID NO: 134856 - DNA, 13529 bp, Homo sapiens
  Payload ID: 6335
  Gene Symbol:
  Gene Name: FMN1
  ENST ID: ENST00000632024
  CDS Start-End: 505-4764
ggaggtcggcgcagctgcccctttgggctttggctctggactggagcgcagcatccttcgaggctgcagccgccacggctgttgccgtaagcaatcctcctgcctcagcctcccgagtagctgggactcgggaccagcctcccgagtattggtcagatgacatttaccatcaccgttttcttcttctttcatcatcatcatcatcaccattgccactaccaccacctccaaggccactaccaccacagcatctctgttcctccatcagagctcttcaagttctgtaaaggcagattctctaaaggcatgcctggtggcatcacgtttttcacatctccgcatctggaccctgcccaagcgaaggctgatctaggcagtctcattgctggagatgactgtcagctgctttctctgcatagccaccatcacatgcctcaccactggagcctgggaagcctgaccacaaaccggcatctccaaggcatgaataattaggtaggcataatggaaggcactcattgtaccctccaattgcataagcccattacggaactctgctacatcagcttctgtcttccaaagggggaagtcagaggattttcatacaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccaggtatctcctctgagggctttccctgggacggcttcaatgagcagacacctaaagaccttcccaacagagatggaggcgcgtgggttctgggctacagagcgggaccagcctgtccatttttgcttcatgaggaaagggagaagtcaaacaggagcgaattgtacttggatctccatcctgaccacagcctgactgagcaggatgacaggactcctggcagacttcaagctgtctggccacccccaaagacaaaagacacagaagaaaaagtgggactgaagtacactgaagcagaataccaagctgctattttacacttgaagagggagcacaaagaagaaattgaaaacctgcaggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccacccccacccccacccccacttcctaactcccctgccccacccaaccctggagggcctcctcctgctccaccacccccaggacttgcacccccacctccccctggactcttctttggacttggctcttcttccagtcaatgtcctcgaaaaccagccatcgagcccagttgtcccatgaagcctttatattggactaggatacaaataagtgataggagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaagatcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggataatgggattaatctggtggactacgttgttaagtattacctgcgttactatgatcaggaagctggaacagaaaagagtgttttccccttgccggaaccacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgccttctttaagaagtccctcattaagccgcaggaacaatggaaaactatttaagggaacattgcagaaatatttgatgactgtttcttgtggaagcccaaagtccactctaagagcagaagaaataccaaaatgtttccaaaatttttttaaaagctgagatttccagctttataaccaaagcttgatatatgtcacattgtcacagaagagagaaaagatcattgaggacagttgccttgggagagttcaagtctttgtcgttacacactgctgttttgattattggtcttagttttgatcctgttgcagcaaaatcctgcagcatctttctctccaataatgttgcaactcaccaaaactattcttgaagaggtccaagaacatgtattatccagactaaaaaaatgattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgttgtgttgatacgcagccgagttctacgttatgtgctgtgactgtgcagctggacgacccccatccccaggaggcagtttccagacaggagagcaaatgcaactcacagcacctgctcatgaccttggctgataggcatgtgaagtaggatgaagcaggactctttaatgtcaaaaaaactgaagggcagaaaaaaggttccttacatcaaaatgaaagtaattacattaatagaaaacttccaagtggaatattgttcacaggcagctctttctgaccctggctcttgagtcacataaggaaaccacctttgacctctctgacacttttgtctttaagccacgtctctgaaatcttgtgaggggtgaagaaagaggactggagatgaatggacaatatgatcaaagactcatttttaggccttgaagaggccgagctttctccccccaattggtggaggacagtccagagatgagcagaaatcttaaattccttcctgatccagcctccacatgtggcctgccccttgccccagcatctttccagaacccctggacttgccaggtgcctgagcatcttcccaggatatgcctgccagccagcagcccctcaggaatgcttctataatagatccagtaatgaaagcagcaccatatcctaatctaatgtcagcttcgagaatgaagactgcagtcaggatcaaatcaagtcacagaagccatattcatgcaggtgctaaccgccttttctactggtgcaactgaaaggaatatggtaacatggttggatttttaaaattcacaatgaaggaacgagacaagcaaaacagaaaagccgagaaggaacatgcatgactaaaaaggcttgaagttgcttgtgagcaagaagctttttatgctgctttcttacatagtttctcttcattttcacttaactctgaagacaaccaaaagaacggatcaattaaaaactgattccacttataaccattgtatgctccttctagtgttatcatgcacaagaaaagtgccagttttacccatgccatataattcagctcttttgagttatgtggggccagcagaagtctcaatccttataggcttgatggtgagagcagcgggaggtttgaggtgtactcattgcagtccactttggtctgtaagtaggatgcttacgagaaatcagtgaaggtaagcagggctgccactgtggccacgtaacccttcaggaaccagtgctgaagaataatgagtgagaacacttaatttgagagttagacaaatacagcccactttggatttcatcctagtgaacagactaaaactttgcagtaaaatacctatttctacaaagcaaggtttgcctgcctcggttggggaaacctagtggttttgtcacactagtcgatgtatgatgttagtgttgtaagacaccatggcagaatcttcattattctcacctattctgaaccctgcatcatgtatctgggatgccccctcccaagtccaccaatgtaccacgttgctgacacagccttcatttttaactcaaattgatgctcagtaaaggtcaatgacaatttgttcaaggaagttcatctaaaataatctggaggccttgaaaatgatccctctaaaatgctgttgagcttgtgttcagtgtagcaggaggatctgaacttttcctggagaggaggtgatcgggatgccatttggcagcttaagcacatcctgccagcaggctttaagtggctgttctaggcatagccctccctgaactagaaaggagagtaaccagtttgctatgctgcatctaaccagacacacctgacttagtagtaactctaagaacccttaacttacaaacaactttgtctcctcttagacaatattcattaaatctgaggacacagtttgacagtagttcagattcttgcatgagcaattgacagcatcagagcacacaatatcataagttacataaattacacaaagtacatcataaattacactacagacacgttaggtaaaaagcatcaggcccgggccgggcgtggtggctcatgcctataatcccagcactttgggaggccaagcgggggcggatcacgaggtcaggagattgagaccatcctggctaacacggtgaaaccccatctctactaaaaatacaaaaaattagccgggcgtggtggtgggcgcctgtagtcccagctactcgggaggctgaggcaggagaatggcgtgaacccaggaggtggagcttgcagctagccgagatagcaccactgcactccagcctgggcgacagtgagactccgtttcaaaaaaaaaagcatcaggcccatgaagtatcaaaaaccaggttaggaggtgtgctgtatggcttttatctcaataagtggcagcttactggggaaaaagaaataagaaaaagtgtggccaagcagaagtggatgtttatgatgacggtgggggcccagaggtcataggtgatggtcctactgcccaacagttgccttttgaatccttatgttgatgatggtgtctttctacacactcactgcaactactcaggaattataaagattttctgaaatctgagaagtggaataaggaaacccagtggagctattacacttttaaatgttctagccaaaacaaattgccagtatggttgaggaattgaatatcagatggcatgcagtctcccctcccctcccctatcaaggacagtagaagctgcaaacctcttctcagcctccttcaggcacctcctgttttcataagcaccatgaagaatggtgtttcctaaatgaaaagttcagatactgctggtaaagaaactggaaaaactgaaggaaggaataaaatatgttggtggtattaacacctccagtaagataagtcattggtacggtttttctaagggccgcagtgagatgtagcagaagaaatatgtttattttgggcaaagatttgcttattggcctgggattgcacattttctctatgatgtttgcaacagagaaattttcattttaatgatactcttcctttcttgaaagttacatgtcctcatttctgtttctgcttctcccttggccagtgtcattgatgcagatcattgcatacaacagcacagcaaattgcgccaagtcagtgtgtgaatgggaattagcaatgcacgcttgcaggctctttttccaggaaccaggctgtaacattgaccggggaacctcttcattccctgacatactaaattggtcaattttgtagtactcatctccatccacaaaaacaacaaagataaaatcaatttggagctttatatgacaaaaaggaagaagtccaaaaatatatagccttcccccctcccacatatctgatccaaatattaaatatctgattttataaaacagtttaaattgtctttttaaattgctaacaagcatcagttatatttgagcttcatttttcttttatcctgtctgtcctaataaaaacaaaaatggccaaaaagtggagaggaaagaaaaagcttccactttttaaaatttgttttgtattagttattttacctttagggaccctacaactgaagagagtggagagaataaagaagtgaactttcattcatgtctgctactttgacctcataaagaaatctgcaacacagatgaaaccagtctgtgtggccaagctgatgggatttgaaaagagtggataatttttagcctttccaaaatgcaaataacttggatatatttccattttccagctatagagagaaacaatccagctgcctggaaactgttattagtatagaagtggcttaaagaaaagcatcttcaaatacttgacttagcatatctttcttctttagacttacataatgatattcatctctccattagcaattgaatccaggcataaccgggctcagttacacagcttgtctgtgactgggaagcccattttgtgtcatttctgcacacctgtccgctgttgacaccttattagaggcactgcattttggtttcacaattcttcatctcccttcccaaggaatgggcaatctactgaacttccagatcaatgctttgttggaaagtgatgaatttaagagagttttaacatgtcaaatttgaagccaattcagtatccttatttgttccaagactcttaaccaatactgtgatataaagttaggatttgggaaacgtgtagttaacaacttggaaacatgaagatattaaaatggcagctggctaactgtctcttaagccactatgcaatttctaccaatggagagattagggaagcaaattaagcctcattcagtaggtctgctgtctggtggaacttacggaactcatttcctcctctatccccagcccttctcctaactatggtgataaccagggccatagaagaccttttctctcttacctttctctgataggatcgtgtccttcagtcaagagctcatgtgaactccagactttatattacatctctgaagttcttgatgtggggaagattgacttttattccatttttatatgaaggtgttagatatagccatcaatttatttttctacattccctctacgcttatgtaattttctatttttaaatcttctcttaaatatactgagaatctctagtctccttttctaaaggctgatccaactacacttgtgggctatttttccaagctttgtgtgaaacttgatgacattgggccagcaaaatgcaaagaagactatagtttcaggcagaaaatcacgtccaaagaatttggcatggattaaacaacctctaccacactatagctctcacataggctgaacattttcctaaattctacctgtgcagacactgaggggctctctacctttgaaactatgagaacgtcttaaattaatatgaatatttctctccatgtatagtgtgagctgccaatgcattatcttaatacatcaagaaggaaatcagatttcaggcacacattagcaattgtttgttaatgtccttggcaaacgtgtacctgctttccttcattgttctcttcaggggctttcttccactttcctcttatgaaacgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagtgagagggaaagtctagtatcaattcttctgtttgctcgcaatgacacaaataggttttggggatctacctaagggataggtctactccaaaattattaaatttataattgtgcaattctgtaatttcccaaggcataagtaatatgaccctactgtcagctagatgtcttatcttcaaagagagtatgcattaataaaaagaacttccctttaaagaaccaatctaaaatactaaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaaggcagtcaacatcctagtatgaatcagacctagcagaaatgtaaattatttcaagtacttcagggtttagttttcttagtgacaccctggaccctggatgctgctttctaaagtgcacctgatccatgcagttttatgtcttcatataactggtatcttgtgagtttgcaagcaatgggatgagcaagaaaaaaaggacgcatggaggagaaaaatttgaacgaggctagtgcaatgttttgctgatagattacattgttagggagctggtgattttttgccatggtcgtatcgtggacagcttttccgtggaaattcaaggcatctgtattaggcaaatgtgagtgcccttgatcttgtattgatcagtgccaatgtactgggaaagcaggtaccccagtgaaactggtctgtgcttggtttaacagctccaacaatttcagatccatggggctgcttgaccatagaccctgtttactccatgcctgttcaaaagtcattttgacttctagctttgtttcactttcttctttcaatacttctgtttcctcgtccttttccttcatattccatggctatttctttcctactttacagtttcccccagacccagattttttcacacctctgcatcatagacaactgagtagctcccttggcccctcctccatcctctcacaccctgtgctccgttcctcagccgtttggacagggagctccgctgtcaccaaggagcccatgtgagacacactgctgtgactgcctcttgttaatgtcagcatcacctcatcacttaagcaaaaaggaaaatccataaaagagatggaaaatacgtctctttttattttattttaagaagattgggcggggtggggggggggttcttattctaggccttctcaatttctcatagattttaccttaaactaattaaggccattctcttgataaatttgtacatcagaccgggtcaccagctatgatgcagaacgccagatttttgaatctcaagtaactttctgtggtgctggacaaattgacttaattctgtgcaggcaaacactttgaatcataaggatttttattgccgctccattcttactactattcatgattcaaacatctacccctgttctgaatcaggatgttgacacttcttggttattttcagatgaacagtaactgctacactcttgaaagcacttaaaagtgcaagcatgtcctaaatagccatttaacctggtaaaacataggcttttctgtttaattaagtattagaccagtctgtagatataatctgaaaagattgtaggcagtaatgaagacagttggggaaaggagaaggccctttaaagacatgaaaccttacacgctcttgggatatttttaagcataataagctcattggattcaggtatttttccctttgcatttttaaaaatacgtatttctaatttgtttgcatatttaattttgtcaaagctgagaaatgctcatgagttgaatttataaatgtcatttgcaaccaaatgaagtatttatttttaaaaagagagtgaaggaaccaacactgatttgtacataataaaaatgtgtgtattatatatatatattttttcctccttgacagtacttggtcacaatatcaagtgtatttttgtacataatatatattgattagaaaaacgtcaattgtctattcaaaaaattctatctctgtgatagattatatttatcctaatctgttgatacctctgttaatttgttttaagagaattatattttttggaatttacagagaattgcattcatggctttcaattgtaaatatgctaagggtattttaataaatcttggtttcatgtcc

SEQ ID NO: 134857 - DNA, 699 bp, Homo sapiens
  Payload ID: 6335
  Gene Symbol:
  Gene Name: FMN1
  ENST ID: ENST00000632025
  CDS Start-End: 1-545
tcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagttttgtttggtt

SEQ ID NO: 134858 - DNA, 393 bp, Homo sapiens
  Payload ID: 6335
  Gene Symbol:
  Gene Name: FMN1
  ENST ID: ENST00000632613
  CDS Start-End: 1-343
accacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaaggccatccctttccgatgtcagcgtgctgtgcctctgttggtgtaaagcatttgtttctcctggaaagtgcacaacggggattttctaagaaatggaaaacgattgccacactcacatcagacggatcccacgtgaagcagagcgcagtccctttgtttcctcgttagcatcacccggctcccatatttgtagagctgtaataaaaacaacttcttaa

SEQ ID NO: 134859 - DNA, 4060 bp, Homo sapiens
  Payload ID: 6335
  Gene Symbol:
  Gene Name: FMN1
  ENST ID: ENST00000631469
  CDS Start-End: 279-1790
tccctggtccgtgtgtagtaaggtgcgcagcctcggctgcttctgggcatagactccacagatttttcacagttgccctggaacacatcatcgcacaaaccggaaggagggcactgtgacccgaaagagaccaagtgtgtttgctgtgcggctgacagcctgactcccgggtcctgttgctctctgtcctgtaaattaagagcagatggagtggataaactgagagcgcaggagaaggtaacacaagtcagaacttccaccaagggcattactgagacatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaatgctgaccaagagagccagagcggccctggagtaccacaaacccagggtggtgaggtcaagccaaagtcgccagagacagccctggaggcttttaaagccctattcatccggccccccagaaaggggaccacagctgacacctctgagctggaagctctcaagcgcaagatgagacatgagaaggagtcgctaagagctgtgtttgaacggtccaattctaagccagcggatggcccctctgattccaaaagtcctgaccacagcctgactgagcaggatgacaggactcctggcagacttcaagctgtctggccacccccaaagacaaaagacacagaagaaaaagtgggactgaagtacactgaagcaggtaatgtgaaaggaagctagggacccgggaatgaatctcttcctgcaatggcttttagttctagcttagttgactctcagaatttggggttttatttcattataaaatgtaatgctgaagggtttctttttggttttgctgttaaagtgaacctttgcacacttattgttaacgagcctctgaaagatgaaagatgaatgcagtggaatgaatgaaagggggaatgtgtgtgaagtaggagaaccttgggggacctgatggagaaggtagattgcaaatccctcaggaagccggtggttggtcctcatacaattttgtgagctggcagtgttgctagaagaggcagagtatggttctctagagctgtaatctgatttgttgtttgtcttcgagtaatgcttttgagataaaggaaccttgtgcagagtgaatgtacagataccgtatcagttactcgttcacttttgtgagacaaagctttatttaatgcatggccaactttaaagcaacctaactctctggaaacctgcctaggaactttacttgaatttatttaaatgaaatgggaatctagatatggttactatttaagtggaagtttcacgtgaactgtaaaatgacaccaaagcattagaggatgggtatgtaagatattaagaattgcatgtgtgtgtatatatccatgaaacctctctgccttcttcctgatatttggagattacctatacgtggcttatatttgttgtttttattaggtgtatgtgtgcattgaggtctatctatctatctggttatagaaaaataacttctttccattcctgttcattgatagacatgaacagatcaaagttgggtggttcagtaggtttttccataatatcaaattactccagtgattgagaacacactggcagttgaatcttgagatgatttctagctttcatttacacagtttctgcagggcattggttacttcatagcattttctttctgtggtgtttgacttacaggatgaaaactcatatccttaatgaaaatatgtatagcaatttaagtcttctttcccacatttgattttccaaaaatcataattgtgtaagaatgaacagcataagggtggaaaatgattgtttcatctgagcagagcaattcagacacagcagtaaagaaagcataaggatgttctaggtaattgaagcatagaagtagcatagggctaaacttctgtttaacccaaacttgaatggaaaatttcctaaaccacattagatcacttttttccttttgctttgtttagtccaaacgcacttaactttattttctctagggtaattacatatatgactgtatcaatgagggtcgtactaatcaggaatcaggtggcactcaaatggagtgatttgaggagagtttattagagacctttcacagaggtacagacggggtttagaaaaagcagtaagagagcgctactctggggccagtaccaaggagaagcttttaccacacccaagcctgaaggggcaagagtagaagtcgctatcgaaaactagaacttaagagggaggctgagtggtgtggaggcagctgctgggcaggacccgcagccctcagcagggaggtgccgccggtccatagtgacatgccaggctgggaactgagggcacacaacctgatctcttctcatcccactctctggtccctcatcgtcattcccattggccaaacccaaagagaagtcagcagactgggagccacttgaggctatcatttcaggcctgtcaccggggcccagaaagggcacagacctggagaagcacgtagaagatcccctgcacagttatggtaccaccatgggcgcccagcaggccctgggcagagagacttctaaagccctcctggagaagaatctgcacagacatgctggtgttgtcataccacacgacacgggagtttagtacaagggcacaaagacaagcttctgttattatcatcctgtgggagggttatattttctagtataatcagttcatagaaaatatacagctattattcgaggcttgctctgtagaaaactacttcattttaatgtgagggatttgtttactgatctcagaaaatctctcataaggttttaaatgttccccaaataaagtaaaatttgaagatatccagaaaaatcatgaagcaaaagaaactttctatgattctatttcagagaaactgttgtcacttttgaaactaggcctatgaatttaatgtggaaaaataaaaatagaatttgaatcat

SEQ ID NO: 134860 - DNA, 7092 bp, Homo sapiens
  Payload ID: 6336
  Gene Symbol: FLT1
  Gene Name: fms-related tyrosine kinase 1
  Uniprot ID: P17948
  ENST ID: ENST00000282397
  CDS Start-End: 253-4269
gcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacata

SEQ ID NO: 134861 - DNA, 2969 bp, Homo sapiens
  Payload ID: 6336
  Gene Symbol: FLT1
  Gene Name: fms-related tyrosine kinase 1
  Uniprot ID: P17948
  ENST ID: ENST00000541932
  CDS Start-End: 286-2487
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccaggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgca

SEQ ID NO: 134862 - DNA, 1275 bp, Homo sapiens
  Payload ID: 6336
  Gene Symbol: FLT1
  Gene Name: fms-related tyrosine kinase 1
  Uniprot ID: P17948
  ENST ID: ENST00000543394
  CDS Start-End: 157-1242
acagagttactaattttgacagggaactgtaccgttttctcccctcagggattttcatcttaatggatcatccccctgcccccatgcttggataaagtgggctggaggcctggaaaaatctctggtgttcatgttgaaactcaaatactcttaaaaatgaactctgatctacttgttgattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcaca

SEQ ID NO: 134863 - DNA, 1911 bp, Homo sapiens
  Payload ID: 6336
  Gene Symbol: FLT1
  Gene Name: fms-related tyrosine kinase 1
  Uniprot ID: P17948
  ENST ID: ENST00000539099
  CDS Start-End: 286-1911
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctaacagttctttcatgttgccacctacaagcttctcttccaactacttccatttccttccgtga

SEQ ID NO: 134864 - DNA, 1927 bp, Homo sapiens
  Payload ID: 6336
  Gene Symbol: FLT1
  Gene Name: fms-related tyrosine kinase 1
  ENST ID: ENST00000540678
  CDS Start-End: 1647-1904
actttaagtcttttccttttggtcttggaggaacagtgctcagcttttgatctctgtgattctgatagagaagctgtttctggaattacaaagtttgcaaacttgacagcaaaatttctggaaagccttttctatgaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttc

SEQ ID NO: 134865 - DNA, 6453 bp, Homo sapiens
  Payload ID: 6336
  Gene Symbol: FLT1
  Gene Name: fms-related tyrosine kinase 1
  Uniprot ID: P17948
  ENST ID: ENST00000615840
  CDS Start-End: 237-2300
gctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtctttttttttttttttaaagaaacttttgggtgggttttgttttttattagttaccctaggggtatgttaccctggggtatgaagggaggtgaagataacggaggggggagaaaaaaaaaaggagaaaaaaggagcctaaaatggggaataattgaaatggaacagggggtgtgaggctggttcctcagtccccattccaaacggaggatagaagctgtgtatttatgtgacctggcagatctctggggccataacactgaaaagtgaaagaacctggtgggcagctatctttggctactgataaccagcagaaatgtctgttaattctgattttctcaatttgaagggatcagctacactgttaaattttggaaagccactacctacttccatcaagtaacttaggtttcgaaatatgggttcaacgcacctcccttattcaaaatgtcaaaatagattattataatgtataaagtaagaattgacaaaatatgattcttgggttgattggtcatttagaaactagccaaaagtgagacttttaatgtagaacatttttcagaaatgggtacaaagaaaaatgcatattactgtatatttcagagtgtttatgtgaaccttgtatttaattgagagtcccatgtacgttctgcagcctttttgctgcttctatcatctgaagtttgtgtagtacaaataaggcctttgggattcttaatgacatttatgttaaaatgttctcttctctttaaacaccgttttccaatccacctgtcagggagtccaaatcgtgtctgtgttgatgatgctatactttgtagctagaaaaacaattttagtgttgtgggctctgtattcagacttcctttttacaagaccgatgggcagtgatagattattttatcatatttaatgcatgggaaatagtgtgctgaggaagctattaaaagtataactcagtgaattgggtctgagttttaaatgagatatttcaaaattggcttgccactgtaaaagcgactaaataataatatgatactgttctttatgatcttgtcatgtttcactgatatgtttggggtcttcactatgtaaaaaatgtcaaaattgtaatgagcaagcatgtacaagtagtcgtaaatcaaaggttttaaacaggactgcattttcaattaggaaaagctgtttggcagatagcatccaatgcaaaaacagaaatatcgtaacgttctgcttagtgggcaagataagataggaaagacatgctcaaagaggcaaaagaatcattgctatcattcattctacactagtttgaagaagtttttgtacatcagagcacttccttcagcacacttttttgccttcagatttcattttttataaaatgagaagactaatgataaactgtagaaatcaaaatttattgagaaatctgtttctcctaacagatagtaaccctgccatgatatactacttcaacaatgttataaaatttatgtgataatatacattttaacctgggatttctaaattgctttaacaaatgctaatcctgagagttgccctgcaggactcaaaagggaaaggttttgggacgtggcagaaccctgcagggacatggaattaaggccattgcaatgtatcatctttgtagcattgtcatcactcctaagctgccttcacagttttagtacactaagatgaggaaatcgaaaatgggcagagaaagctcatactgtataattgaagacagtgacagagaacgtgtcagttatgccaaaactcttttgatttctgttccaggatttccaacaagaggggaaaggaatgacttgggagggtgggaaagacattaggagttgtttttattttttaccttggaagctttagctaccaatccagtaccctcctaactagaatgtatacacatcagcaggactgactgactacttcattagagatatactgtactcattgggggccttgggggtactgctgttcttatgtgggattttaatgttgtaatgtattgcatcttaatgtattgaattcattttgttgtactatattggttggcattttattaaaataaattgtattgtatcatatttgtatgttttaagagaaaataatataaaatacaatatttgtactattatatagtgcaaaaactacaaatctgtgcctctgcctcttgaattaattctttggttgcttgcatttgggaagggaatggagaaaggaaagaaccaataaagctttcaaagttcaagaaa

SEQ ID NO: 134866 - DNA, 1476 bp, Homo sapiens
  Payload ID: 6336
  Gene Symbol: FLT1
  Gene Name: fms-related tyrosine kinase 1
  ENST ID: ENST00000615611
  CDS Start-End: 134-1435
tgcatgcccagcccaggcatgcagtggaaacgcagggcaggagagaggaggccttcagagtgcagctggacttccttcccaaccctcttgcttccttcagaccggggtcgggttggcaaaccaagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatt

SEQ ID NO: 134867 - DNA, 434 bp, Homo sapiens
  Payload ID: 6336
  Gene Symbol: FLT1
  Gene Name: fms-related tyrosine kinase 1
  ENST ID: ENST00000617835
  CDS Start-End: 136-393
tatgctcctttcccctgaggttctacagattgaacagctgtgttcctacccaatcacaatgggagaagctaaccagtatagcctggcaaacaagaggactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatt

SEQ ID NO: 134868 - DNA, 3842 bp, Homo sapiens
  Payload ID: 6337
  Gene Symbol: FLT3
  Gene Name: fms-related tyrosine kinase 3
  Uniprot ID: P36888
  ENST ID: ENST00000241453
  CDS Start-End: 83-3064
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccaca

SEQ ID NO: 134869 - DNA, 3634 bp, Homo sapiens
  Payload ID: 6337
  Gene Symbol: FLT3
  Gene Name: fms-related tyrosine kinase 3
  ENST ID: ENST00000380987
  CDS Start-End: 83-2302
acctgcagcgcgaggcgcgccgctccaggcggcatcgcagggctgggccggcgcggcctggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgacgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagtaaaaagaaatgagctttacaaaggcaaactggaaaaaagaaggatggtgaaacgcttacgggactctcgggaagatctgtattatgtgagggaaagtgggctgagttcagaaaccaaagaatgagatcgatcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaa

SEQ ID NO: 134870 - DNA, 1046 bp, Homo sapiens
  Payload ID: 6338
  Gene Symbol: FLT3LG
  Gene Name: fms-related tyrosine kinase 3 ligand
  Uniprot ID: P49771
  ENST ID: ENST00000204637
  CDS Start-End: 347-808
ctgtcacccggcttggccccttccacacccaactggggcaagcctgacccggcgacaggaggcatgaggggcccccggccgaaatgacagtgctggcgccagcctggagcccaacacacccgctcccctgcagacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134871 - DNA, 951 bp, Homo sapiens
  Payload ID: 6338
  Gene Symbol: FLT3LG
  Gene Name: fms-related tyrosine kinase 3 ligand
  Uniprot ID: P49771
  ENST ID: ENST00000597551
  CDS Start-End: 86-793
ggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaat

SEQ ID NO: 134872 - DNA, 591 bp, Homo sapiens
  Payload ID: 6338
  Gene Symbol: FLT3LG
  Gene Name: fms-related tyrosine kinase 3 ligand
  ENST ID: ENST00000598555
  CDS Start-End: 1-562
cgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggagacctccgagcagctggtggcgctgaagccctggatcactcgccagaacttctcccggtgcctggagctgcagtgtcagcccggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134873 - DNA, 1076 bp, Homo sapiens
  Payload ID: 6338
  Gene Symbol: FLT3LG
  Gene Name: fms-related tyrosine kinase 3 ligand
  Uniprot ID: P49771
  ENST ID: ENST00000594009
  CDS Start-End: 80-787
ggggcatgagggtccgagacttgttcttctgtcccttccaagacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134874 - DNA, 1034 bp, Homo sapiens
  Payload ID: 6338
  Gene Symbol: FLT3LG
  Gene Name: fms-related tyrosine kinase 3 ligand
  ENST ID: ENST00000596435
  CDS Start-End: 92-745
gtctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134875 - DNA, 984 bp, Homo sapiens
  Payload ID: 6338
  Gene Symbol: FLT3LG
  Gene Name: fms-related tyrosine kinase 3 ligand
  Uniprot ID: P49771
  ENST ID: ENST00000600429
  CDS Start-End: 68-775
ccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaat

SEQ ID NO: 134876 - DNA, 1301 bp, Homo sapiens
  Payload ID: 6338
  Gene Symbol: FLT3LG
  Gene Name: fms-related tyrosine kinase 3 ligand
  Uniprot ID: P49771
  ENST ID: ENST00000595510
  CDS Start-End: 302-763
gacccggcgacaggaggcatgaggggcccccggccgaaatgacagtgctggcgccagcctggagcccaacacacccgctcccctgcagacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgtagagatggggtttcgccatgttggccaggctggtctcaaactcctgatctcagctgatccgcccgcctcagcctcccaaagtgctgggatgacaggtgtgagccactgttcctggcccatgctgggctttccacaaatgaactcacttccttgagaagttcgtgccattatgatcccaaggcatagagaggtaaataatttgccaaaagtcacacagctcaagggtgacaaccaagatttgacttcaggttgtcttttttttttttttgagatggagtcttgctctgtcgcccaggctgtagtgcagtggcatgatctcggctcactgcagcccccgcctcccaggttcaagtgattctcctgcctcagcctctggagtagctgggattacaggtacccaccaccacactcggctaatttttgtatttgtagtagagacggggtttcaccatgttggccaggctggtctcgaactcctgaccttagctgatccgcccgcctcagcctcccaaagtg

SEQ ID NO: 134877 - DNA, 1032 bp, Homo sapiens
  Payload ID: 6338
  Gene Symbol: FLT3LG
  Gene Name: fms-related tyrosine kinase 3 ligand
  ENST ID: ENST00000601800
  CDS Start-End: 113-289
aaaaatttcctttcactttcggtctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgccaggcctgatcctgttttctcccgcagtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134878 - DNA, 1057 bp, Homo sapiens
  Payload ID: 6338
  Gene Symbol: FLT3LG
  Gene Name: fms-related tyrosine kinase 3 ligand
  ENST ID: ENST00000600084
  CDS Start-End: 84-260
ctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgccaggcctgatcctgttttctcccgcagtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 134879 - DNA, 1161 bp, Homo sapiens
  Payload ID: 6338
  Gene Symbol: FLT3LG
  Gene Name: fms-related tyrosine kinase 3 ligand
  ENST ID: ENST00000597914
  CDS Start-End: 1-397
cagctgtcttcgcttcgtccagaccaacatctcccgcctcctgcaggagacctccgagcagctggtggcgctgaagccctggatcactcgccagaacttctcccggtgcctggagctgcagtgtcagcccggtgccccccgtccccagtccccaggacctgctgcttgtggagcactgacctggccaaggcctcatcctggtgagtccttcctgggctatggggcctggactttgtgtctgcaggttgggagggtcactaggaggccatggaagggtggtgagcagtggaggggcaggggcagctctaggtgcagaaagacccctctggggccaggcgcggtggctcacgcctgtaatcccagcactttgggaggccgaggcgggtggatcacttgaggtcaggagttcaagaccagcctggccaacatggcaaaccccagtctctactaaaaatacaaaaattaactgggcatagtggtgtgtgcctgtaatcccagctactcaggaggctgaggaaggagaattgcttgaacccaggaggcggaggttgcagtgagccgagattgcgccactggactccagcctgagtgacagagctagactccgtctcaaaaaaaaaaaaaaaaaagaaaaggaaagacccctctggggccacggagacagactggagaccaagccggaggctgtgggaaggcccagggtgaggaccatgactgagccagggctgggaccatgggatggagtggagtggatgggcagagagtcaggggtcagagatcaggagggaccggcctggggcctgacaggcttgagttggcacagatagccctggtccagtgatggggtggacaggggggaacctgggggaggagtcagattagggaaagacatggagctcactggggacctgaaggagcaaggggccctggggagatctgtggatgtgggagtttgcaagcctcctgggacaggaaggaaatggcattccagaaagagggaactgcctttggaagccctttggtatgagaaagctcagggtgttccagtaacttgggccagcgtggggcagcaaggagccatgggaggtgtgagagggaggaaaggagctgggaacaggtgtggagggtgcaggcaggtaggcaggtgggccaggagggaag

SEQ ID NO: 134880 - DNA, 5857 bp, Homo sapiens
  Payload ID: 6339
  Gene Symbol: FLT4
  Gene Name: fms-related tyrosine kinase 4
  Uniprot ID: P35916
  ENST ID: ENST00000261937
  CDS Start-End: 80-4171
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcagctgtaaaggacctggccagaatgtggctgtgaccagggcacaccctgactcccaagggaggcggcggcggcctgagcggggggcccgaggaggccaggtgttttacaacagcgagtatggggagctgtcggagccaagcgaggaggaccactgctccccgtctgcccgcgtgactttcttcacagacaacagctactaagcagcatcggacaagacccccagcacttgggggttcaggcccggcagggcgggcagagggctggaggcccaggctgggaactcatctggttgaactctggtggcacaggagtgtcctcttccctctctgcagacttcccagctaggaagagcaggactccaggcccaaggctcccggaattccgtcaccacgactggccagggccacgctccagctgccccggcccctccccctgagattcagatgtcatttagttcagcatccgcaggtgctggtcccggggccagcacttccatgggaatgtctctttggcgacctcctttcatcacactgggtggtggcctggtccctgttttcccacgaggaatctgtgggtctgggagtcacacagtgttggaggttaaggcatacgagagcagaggtctcccaaacgccctttcctcctcaggcacacagctactctccccacgagggctggctggcctcacccacccctgcacagttgaagggaggggctgtgtttccatctcaaagaaggcatttgcagggtcctcttctgggcctgaccaaacagccaactagcccctggggtggccaccagtatgacagtattatacgctggcaacacagaggcagcccgcacacctgcgcctgggtgttgagagccatcctgcaagtctttttcaacagaacttcacagactgttagagctgctgagaagaatttgctttccgaattcagcctggaaggcgcccagggacagctgtactgagtctagatgactctgacccccgccccaggtcaaggccagcagagcagtcagtgcctctggagaaggcccttgctctcccacctggcccagactccgaggagcctgggtctggagctgccggtctggttcttccctttagagcccggatctgccacctgcggcccctcccaagccgtgaaccagctcatgagagatgaacactgtgggatccactcaggaaggctcggggctggcacaaaggaccacccagcattgccctgtgccacccagcactcagtggacattctggggacctgccttcagccttttcctgccctgtgcctgacatcagcaccctggctggtcagaatgccgccctcccagaggagcagccgagagatcccctgaaggctggaggcattctgctcaggacccctatcccagctcacagtgcccaaccatctcaccaggagaaagagccacatccccacgttaggaccacggagactgaccaccaccctgaccccccaaacccacgcaccagacgcttgcaggacaggcgccgcgcagcgggcaggggcttgcccggccgaccctcccctccccacctcccccactgcgcgttactccaggatatgccgagtgcacgtataaggtcatcttcgtcgtccccgtggacctcccccttcctctgcacgtcgtccaacgtgggactggcgtgtcaggcttccctgggaggatctggaggttgttctctgcagagaaccagcctggctcctggcgcgcacctctgctcccttctcctcactacccacccacgcatgtaccgggaaaaaaactactatgcccttctagaccatgttctgagaaaagatcgaaaatatttaacaagagataataataaatctgatgccggtctttgtgtgtgttgcgga

SEQ ID NO: 134881 - DNA, 4292 bp, Homo sapiens
  Payload ID: 6339
  Gene Symbol: FLT4
  Gene Name: fms-related tyrosine kinase 4
  Uniprot ID: P35916
  ENST ID: ENST00000393347
  CDS Start-End: 80-3976
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcaggtagctgaagcagagagagagaaggcagcatacgtcagcattttcttctctgcacttataagaaagatcaaagactttaagactttcgctatttcttctactgctatctactacaaacttcaaagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctgagt

SEQ ID NO: 134882 - DNA, 580 bp, Homo sapiens
  Payload ID: 6339
  Gene Symbol: FLT4
  Gene Name: fms-related tyrosine kinase 4
  ENST ID: ENST00000512795
  CDS Start-End: 154-580
cagagggcgccacggccagcgagcaccgcgcgctgatgtcggagctcaagatcctcattcacatcggcaaccacctcaacgtggtcaacctcctcggggcgtgcaccaagccgcagggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctct

SEQ ID NO: 134883 - DNA, 4140 bp, Homo sapiens
  Payload ID: 6339
  Gene Symbol: FLT4
  Gene Name: fms-related tyrosine kinase 4
  ENST ID: ENST00000502649
  CDS Start-End: 56-3976
actttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctg

SEQ ID NO: 134884 - DNA, 3806 bp, Homo sapiens
  Payload ID: 6339
  Gene Symbol: FLT4
  Gene Name: fms-related tyrosine kinase 4
  ENST ID: ENST00000619105
  CDS Start-End: 80-967
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcagaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcaggta

SEQ ID NO: 134885 - DNA, 1374 bp, Homo sapiens
  Payload ID: 6340
  Gene Symbol:
  Gene Name: FO538757.2
  ENST ID: ENST00000623834
  CDS Start-End: 1-1080
atgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtggcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctccaggggaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgtccggcattgccaacgacctcatgtacattgccgacctgggccccggcattgccccctctgcccctggcaccattccagaactgcccaccttccacactgaggtagccgagcctctcaaggtagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttttgtctgcctgtgctccatggggggacggctccacccagcctgcgccactgtgttcttctcttaagaggcttccagagaaaacggcacaccaatcaataaagaactgagcag

SEQ ID NO: 134886 - DNA, 1604 bp, Homo sapiens
  Payload ID: 6340
  Gene Symbol:
  Gene Name: FO538757.2
  ENST ID: ENST00000624735
  CDS Start-End: 237-1604
ggaaagcgggtcaaggcgtagggctggagggcaggggcgggccctgggcctgggctgggggtcctgccccggggcgcaccccgggcaagggctgcccggaggagccgaggctggcggacagcttggccctgagcttgaggggaaggcagcgatgggacaaaggacggaggtctgggaagagggtctgcagagcagaaagcacgggtaggggcggcctgacgctcggaagacaacgcatgggagccgtgtgcacgtcgggagctcggagtgagcgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgggtaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgtccggcattgccaacgacctcatgtacattgccgacctgggccccggcattgccccctctgcccctggcaccattccagaactgcccaccttccacactgaggtagccgagcctctcaagacctacaagatggggtacacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatctggggcggggacttttgtctgcctgtgctccatggggggacggctccacccagcctgcgccactgtgttcttaagaggcttccagagaaaacggcacaccaatcaataaagaactga

SEQ ID NO: 134887 - DNA, 1687 bp, Homo sapiens
  Payload ID: 6340
  Gene Symbol:
  Gene Name: FO538757.2
  ENST ID: ENST00000623083
  CDS Start-End: 1-1395
atgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtataagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgtccggcattgccaacgacctcatgtacattgccgacctgggccccggcattgccccctctgcccctggcaccattccagaactgcccaccttccacactgaggtagccgagcctctcaaggtagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttttgtctgcctgtgctccatggggggacggctccacccagcctgcgccactgtgttcttctcttaagaggcttccagagaaaacggcacaccaatcaataaagaactgagc

SEQ ID NO: 134888 - DNA, 718 bp, Homo sapiens
  Payload ID: 6341
  Gene Symbol:
  Gene Name: FO538757.3
  ENST ID: ENST00000624431
  CDS Start-End: 317-718
cttgccgtcagccttttctttgacctcttctttctgttcatgtgtatttgctgtctcttagcccagacttcccgtgtcctttccaccgggcctttgagaggtcacagggtcttgatgctgtggtcttcatctgcaggtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgacagcatcaacttctctcacaacctaggccagctcctgtctccccccaggtgtgtggtgatgccaggcatgcccttccccagcatcaggtctccagagctgcagaagacgacggccgacttggatcacactcttgtgagtgtccccagtgttgcagagagcctccaccaccccgagatcacatttctcactgccttttgtctgcccagtttcaccagaagtaggcctcttcctgacaggcagctgcaccactgcctggcgctgtgcccttcctttgctctgcccgctggagacggtgtttgtcatgggcctggtctgcagggatcctgctacaaaggtgaaacccaggagagtgtggagtccagagtgttgccaggacccaggcacaggcattag

SEQ ID NO: 134889 - DNA, 5765 bp, Homo sapiens
  Payload ID: 6342
  Gene Symbol: FOCAD
  Gene Name: focadhesin
  Uniprot ID: Q5VW36
  ENST ID: ENST00000338382
  CDS Start-End: 34-5439
gaagctgcacacatacatgtaagagaagcaaaaatgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttg

SEQ ID NO: 134890 - DNA, 6096 bp, Homo sapiens
  Payload ID: 6342
  Gene Symbol: FOCAD
  Gene Name: focadhesin
  Uniprot ID: Q5VW36
  ENST ID: ENST00000380249
  CDS Start-End: 365-5770
gttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtatctcagatggaaatgcagaaatcaccgtcttctccatcgctcacgctgggagctgtagaccggagctgttcctattcggccatctttgctcctccctgcaactaactccattcttaattgaccatcaaggaaatttccatccacacagattagcagttgaaaatgaagctgcacacatacatgtaagagaagcaaaaatgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagcagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttg

SEQ ID NO: 134891 - DNA, 572 bp, Homo sapiens
  Payload ID: 6342
  Gene Symbol: FOCAD
  Gene Name: focadhesin
  ENST ID: ENST00000604254
  CDS Start-End: 32-572
gctaagatcatgaatttagcttaaaaccttaatgccgaaggtcttctctgtgtattttgtgtgcctctgtcctgcccttgggaagatctgtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagg

SEQ ID NO: 134892 - DNA, 559 bp, Homo sapiens
  Payload ID: 6342
  Gene Symbol: FOCAD
  Gene Name: focadhesin
  ENST ID: ENST00000603695
  CDS Start-End: 263-559
acatttataatgtggcttgctggtttgtccaagctcagatagcttcagttttttttttgtttgtttttctgtttttttgtttttttaatatatatacatgtgggcttttaggaacactgaaattgtttcaagccttataaagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctc

SEQ ID NO: 134893 - DNA, 4195 bp, Homo sapiens
  Payload ID: 6342
  Gene Symbol: FOCAD
  Gene Name: focadhesin
  ENST ID: ENST00000605086
  CDS Start-End: 163-3876
tgcaactagagtttcttcaatattttctaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatggattgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacaaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtc

SEQ ID NO: 134894 - DNA, 592 bp, Homo sapiens
  Payload ID: 6342
  Gene Symbol: FOCAD
  Gene Name: focadhesin
  ENST ID: ENST00000603648
  CDS Start-End: 68-208
cactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagatcatctgactgagacaggcttagaagatacttcaactcattctaaatgctgcacaatgaataaaatcaaatttatccttactgggctatacaatacctatcacagtacctggtgcataatctatatgtaaattttaaagttcaagtcctcagcttcctctggactcatact

SEQ ID NO: 134895 - DNA, 635 bp, Homo sapiens
  Payload ID: 6342
  Gene Symbol: FOCAD
  Gene Name: focadhesin
  ENST ID: ENST00000603044
  CDS Start-End: 251-635
aattttaataaaaatataacacagattctgaactgttgctaagatcatgaatttagcttaaaaccttaatgccgaaggtcttctctgtgtattttgtgtgcctctgtcctgcccttgggaagatctgaagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgta

SEQ ID NO: 134896 - DNA, 2635 bp, Homo sapiens
  Payload ID: 6343
  Gene Symbol: FOLH1
  Gene Name: folate hydrolase (prostate-specific membrane antigen) 1
  Uniprot ID: Q04609
  ENST ID: ENST00000256999
  CDS Start-End: 262-2514
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 134897 - DNA, 2258 bp, Homo sapiens
  Payload ID: 6343
  Gene Symbol: FOLH1
  Gene Name: folate hydrolase (prostate-specific membrane antigen) 1
  Uniprot ID: Q04609
  ENST ID: ENST00000343844
  CDS Start-End: 812-2140
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatat

SEQ ID NO: 134898 - DNA, 2697 bp, Homo sapiens
  Payload ID: 6343
  Gene Symbol: FOLH1
  Gene Name: folate hydrolase (prostate-specific membrane antigen) 1
  Uniprot ID: Q04609
  ENST ID: ENST00000340334
  CDS Start-End: 370-2577
agatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 134899 - DNA, 2403 bp, Homo sapiens
  Payload ID: 6343
  Gene Symbol: FOLH1
  Gene Name: folate hydrolase (prostate-specific membrane antigen) 1
  Uniprot ID: Q04609
  ENST ID: ENST00000356696
  CDS Start-End: 124-2283
ggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 134900 - DNA, 660 bp, Homo sapiens
  Payload ID: 6343
  Gene Symbol: FOLH1
  Gene Name: folate hydrolase (prostate-specific membrane antigen) 1
  ENST ID: ENST00000529648
  CDS Start-End: 230-376
gcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgtaacagaggcaagcttgggaactgtgtgaaccaggtcagcaatctggacaggtctttaccagcgggtcttttgctgtttttcctgggtactgatttgcagacttgatccaactttctaagaaaagcagaaccacacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatc

SEQ ID NO: 134901 - DNA, 2225 bp, Homo sapiens
  Payload ID: 6343
  Gene Symbol: FOLH1
  Gene Name: folate hydrolase (prostate-specific membrane antigen) 1
  Uniprot ID: Q04609
  ENST ID: ENST00000533034
  CDS Start-End: 106-2220
ccaccgcgcgccgcccgcgctggctgtgcgctggggcgctggtgctggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagagga

SEQ ID NO: 134902 - DNA, 540 bp, Homo sapiens
  Payload ID: 6343
  Gene Symbol: FOLH1
  Gene Name: folate hydrolase (prostate-specific membrane antigen) 1
  ENST ID: ENST00000529117
  CDS Start-End: 347-540
atgtggggtgagcacccctcgagttaggaggagggtagctgggaacggtgcagggctgagttctcgacaagctgctggtaggacagtcactcaggttgagggtagaactgagagaacctgaaactgggcgtaggaaggttccaagtgctggagccctgcaagacagaggaagttttttttttgcttttgttttgttttgttttgttttgtttgtttgtttgtttttttacctctctgtgcattctttcttccttggaagtaacagaggcaagcttgggaactgtgtgaaccagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataa

SEQ ID NO: 134903 - DNA, 2192 bp, Homo sapiens
  Payload ID: 6343
  Gene Symbol: FOLH1
  Gene Name: folate hydrolase (prostate-specific membrane antigen) 1
  ENST ID: ENST00000525826
  CDS Start-End: 194-418
agtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttataattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatat

SEQ ID NO: 134904 - DNA, 751 bp, Homo sapiens
  Payload ID: 6343
  Gene Symbol: FOLH1
  Gene Name: folate hydrolase (prostate-specific membrane antigen) 1
  ENST ID: ENST00000533510
  CDS Start-End: 185-325
tagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgtgaaagtaggcaagagaaattaaaattcagaaatatctcacctaatgtcagagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagg

SEQ ID NO: 134905 - DNA, 1107 bp, Homo sapiens
  Payload ID: 6344
  Gene Symbol: FOLR1
  Gene Name: folate receptor 1 (adult)
  Uniprot ID: P15328
  ENST ID: ENST00000312293
  CDS Start-End: 211-984
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcac

SEQ ID NO: 134906 - DNA, 947 bp, Homo sapiens
  Payload ID: 6344
  Gene Symbol: FOLR1
  Gene Name: folate receptor 1 (adult)
  Uniprot ID: P15328
  ENST ID: ENST00000393676
  CDS Start-End: 50-823
tccgcattccttggtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcaca

SEQ ID NO: 134907 - DNA, 1331 bp, Homo sapiens
  Payload ID: 6344
  Gene Symbol: FOLR1
  Gene Name: folate receptor 1 (adult)
  Uniprot ID: P15328
  ENST ID: ENST00000393679
  CDS Start-End: 437-1210
ggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 134908 - DNA, 1061 bp, Homo sapiens
  Payload ID: 6344
  Gene Symbol: FOLR1
  Gene Name: folate receptor 1 (adult)
  Uniprot ID: P15328
  ENST ID: ENST00000393681
  CDS Start-End: 167-940
actaaaccacagctgtcccctggaataaggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 134909 - DNA, 1138 bp, Homo sapiens
  Payload ID: 6345
  Gene Symbol: FOLR2
  Gene Name: folate receptor 2 (fetal)
  Uniprot ID: P14207
  ENST ID: ENST00000298223
  CDS Start-End: 188-955
ctaagtagggagatttcactcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 134910 - DNA, 699 bp, Homo sapiens
  Payload ID: 6345
  Gene Symbol: FOLR2
  Gene Name: folate receptor 2 (fetal)
  ENST ID: ENST00000321324
  CDS Start-End: 69-699
gtggggacagcctaggggcctggatctattgcctacttagagagaggccaactcagacacagccgtgtatgctcccagcagcaacggaggttcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagcc

SEQ ID NO: 134911 - DNA, 1242 bp, Homo sapiens
  Payload ID: 6345
  Gene Symbol: FOLR2
  Gene Name: folate receptor 2 (fetal)
  ENST ID: ENST00000449475
  CDS Start-End: 299-1054
agcaattctctagattttgatgaaagttgaatgtgtggatgctggaatgagtaaattaacaagtaaggagatgaatgcaagcaggaatgactaaatggacagactcagggagccttgaagagggtggggtctggaagggaaggaagagaggaaggagaatagctaagtagggagatttcactcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataattcca

SEQ ID NO: 134912 - DNA, 951 bp, Homo sapiens
  Payload ID: 6345
  Gene Symbol: FOLR2
  Gene Name: folate receptor 2 (fetal)
  ENST ID: ENST00000454954
  CDS Start-End: 119-763
ctcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagtgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataattcca

SEQ ID NO: 134913 - DNA, 697 bp, Homo sapiens
  Payload ID: 6345
  Gene Symbol: FOLR2
  Gene Name: folate receptor 2 (fetal)
  ENST ID: ENST00000536778
  CDS Start-End: 104-697
agcgcgttgtctaccctgtaccgaagacagaggctgtggggacagcctaggggcctggatctattgcctacttagagagaggccaactcagacacagccgtgtatgctcccagcagcaacggagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgt

SEQ ID NO: 134914 - DNA, 556 bp, Homo sapiens
  Payload ID: 6345
  Gene Symbol: FOLR2
  Gene Name: folate receptor 2 (fetal)
  ENST ID: ENST00000538353
  CDS Start-End: 48-556
aggacttggtttccctaccctagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcagctgccctttgtgaaggcctctggagtcactcata

SEQ ID NO: 134915 - DNA, 647 bp, Homo sapiens
  Payload ID: 6345
  Gene Symbol: FOLR2
  Gene Name: folate receptor 2 (fetal)
  ENST ID: ENST00000539412
  CDS Start-End: 106-647
agagcgcgttgtctaccctgtaccgaagacagaggctgtggggacagcctaggggcctggatctattgcctacttagagagaggccaactcagacacagccgtgtatgctcccagcagcaacggagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccg

SEQ ID NO: 134916 - DNA, 551 bp, Homo sapiens
  Payload ID: 6345
  Gene Symbol: FOLR2
  Gene Name: folate receptor 2 (fetal)
  ENST ID: ENST00000541003
  CDS Start-End: 106-551
agagcgcgttgtctaccctgtaccgaagacagaggctgtggggacagcctaggggcctggatctattgcctacttagagagaggccaactcagacacagccgtgtatgctcccagcagcaacggaggttcagaaagatcatgctggctcctgtggggaaggcaacttgaaggggaagaaattggaagagggaagacttgacactaaacatagagccatgctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtg

SEQ ID NO: 134917 - DNA, 610 bp, Homo sapiens
  Payload ID: 6345
  Gene Symbol: FOLR2
  Gene Name: folate receptor 2 (fetal)
  ENST ID: ENST00000535625
  CDS Start-End: 96-610
aggctgtggggacagcctaggggcctggatctattgcctacttagagagaggccaactcagacacagccgtctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctt

SEQ ID NO: 134918 - DNA, 1126 bp, Homo sapiens
  Payload ID: 6345
  Gene Symbol: FOLR2
  Gene Name: folate receptor 2 (fetal)
  ENST ID: ENST00000619261
  CDS Start-End: 125-859
atttcactcagtgcttaccagagcgcgttgtctaccctgtaccgaagacagaggctgtggggacagcctaggggcctggatctattgcctacttagagagaggccaactcagacacagccgtgtatgctcccagcagcaacggaggttcagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaatgcagtccctggaagaagaatgcctgctgcacagccagcaccagccaggagctgcacaaggacacctcccgcctgtacaactttaactgggaccactgcggcaagatggagcccgcctgcagcgccacttcatccaggacacctgtctctatgagtgctcaccaacctggggccctggatccagcagggatcagagctggcgcaaagaacgcttcctggatgtgcccttatgcaaagaggactgtcagcgctggtgggaggattgtcacacctcccacacgtgcaagagcaactggcacagaggatgggactggacctcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataattcc

SEQ ID NO: 134919 - DNA, 805 bp, Homo sapiens
  Payload ID: 6346
  Gene Symbol: FOLR3
  Gene Name: folate receptor 3 (gamma)
  Uniprot ID: P41439
  ENST ID: ENST00000442948
  CDS Start-End: 17-331
gcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 134920 - DNA, 335 bp, Homo sapiens
  Payload ID: 6346
  Gene Symbol: FOLR3
  Gene Name: folate receptor 3 (gamma)
  ENST ID: ENST00000546166
  CDS Start-End: 112-335
acagcagagatctgggcctgggagggagagagtacacaatcacatggctgttgcccctgtctcaggccttgtctacctctgactgtggctctctggcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaagga

SEQ ID NO: 134921 - DNA, 992 bp, Homo sapiens
  Payload ID: 6346
  Gene Symbol: FOLR3
  Gene Name: folate receptor 3 (gamma)
  ENST ID: ENST00000612844
  CDS Start-End: 66-584
gagcaagctggtgtcagagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccaggtgggagctcctcaagggccctccccaggaagtgttcctctggatgacctacctggggcagaggagccagaatatggaggagatggctgtggtggggagagacttagtcctgtgtcttccccacccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctatgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatgtg

SEQ ID NO: 134922 - DNA, 820 bp, Homo sapiens
  Payload ID: 6346
  Gene Symbol: FOLR3
  Gene Name: folate receptor 3 (gamma)
  ENST ID: ENST00000611028
  CDS Start-End: 24-761
ggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctatgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 134923 - DNA, 749 bp, Homo sapiens
  Payload ID: 6346
  Gene Symbol: FOLR3
  Gene Name: folate receptor 3 (gamma)
  ENST ID: ENST00000622388
  CDS Start-End: 215-749
aggaaaagcagcaaaccagatggagaaggaaggccaaaaagataagtagaaagctggaccatgagctccttgagggcagggactgaatggttactatgtccccagggcccagcatgaccttctcctggattcctcatcttccttctgtgacctgtgtctccatcagtttctcctccggcatctttttcttacaggattcttacctcaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctatgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttg

SEQ ID NO: 134924 - DNA, 2176 bp, Homo sapiens
  Payload ID: 6347
  Gene Symbol: FSHR
  Gene Name: follicle stimulating hormone receptor
  Uniprot ID: P23945
  ENST ID: ENST00000304421
  CDS Start-End: 65-2074
ctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttactatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaa

SEQ ID NO: 134925 - DNA, 2784 bp, Homo sapiens
  Payload ID: 6347
  Gene Symbol: FSHR
  Gene Name: follicle stimulating hormone receptor
  ENST ID: ENST00000406846
  CDS Start-End: 121-2208
tgaccctaccagttctcaagtcagatctcttctcataagggcactgtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctagatatttcaagaacaaggatccattccctgcctagctatggcttagaaaatcttaagaagctgagggccaggtcgacttacaacttaaaaaagctgcctactctggaaaagcttgtcgccctcatggaagccagcctcacctatcccagccattgctgtgcctttgcaaactggagacggcaaatctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaagtggttgacgtgacctgctcccctaagccagatgcattcaacccatgtgaagatatcatggggtacaacatcctcagagtcctgatatggtttatcagcatcctggccatcactgggaacatcatagtgctagtgatcctaactaccagccaatataaactcacagtccccaggttccttatgtgcaacctggcctttgctgatctctgcattggaatctacctgctgctcattgcatcagttgatatccataccaagagccaatatcacaactatgccattgactggcaaactggggcaggctgtgatgctgctggctttttcactgtctttgccagtgagctgtcagtctacactctgacagctatcaccttggaaagatggcataccatcacgcatgccatgcagctggactgcaaggtgcagctccgccatgctgccagtgtcatggtgatgggctggatttttgcttttgcagctgccctctttcccatctttggcatcagcagctacatgaaggtgagcatctgcctgcccatggatattgacagccctttgtcacagctgtatgtcatgtccctccttgtgctcaatgtcctggcctttgtggtcatctgtggctgctatatccacatctacctcacagtgcggaaccccaacatcgtgtcctcctctagtgacaccaggatcgccaagcgcatggccatgctcatcttcactgacttcctctgcatggcacccatttctttctttgccatttctgcctccctcaaggtgcccctcatcactgtgtccaaagcaaagattctgctggttctgtttcaccccatcaactcctgtgccaaccccttcctctatgccatctttaccaaaaactttcgcagagatttcttcattctgctgagcaagtgtggctgctatgaaatgcaagcccaaatttataggacagaaacttcatccactgtccacaacacccatccaaggaatggccactgctcttcagctcccagagtcaccagtggttccacttacatacttgtccctctaagtcatttagcccaaaactaaaacacaatgtgaaaatgtatctgagtattgaatgataattcagtcttgcctttgaagggtatgtcacaaagagctgacagtgcttctacacatttcatctaatttaatattcctggcatacctttaaggtaaattggtcaggaactattaattccatgtgatacattaggaagctgaattattagtaacaacaataataattaaagaatgcaatactgtattacatattttatccttatatatgttatttttgcacgttatgttcaaagtgcttttgttcagatatctcaagtgatccctgttaaataagcaggacagggattattcttggagttttacaaatgaggaaaccacgactcaaagagttaagtgacttgttcaaaattgtttagtttgtaagaggcagagccaggattaggtattccgactcccagagaatttcccagagaagcaccatggtattcattcattcattcattcaacaaatattaattgaacacccatctgaagcctttgtaatgcgtcagtgtggataggctgaaatacatttcccagatttcccttcctcatgtgttt

SEQ ID NO: 134926 - DNA, 936 bp, Homo sapiens
  Payload ID: 6347
  Gene Symbol: FSHR
  Gene Name: follicle stimulating hormone receptor
  ENST ID: ENST00000419927
  CDS Start-End: 111-569
agttctcaagtcagatctcttctcataagggcactgtgtggagcttctgagatctgtggaggtttttctctgcaaatgcaggaagaaatcaggtggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctatccttctcttcttttgttttggagaatgccaaagtggaaaatggggatcatagagccttcagtgacagaacaaatgctctctaggacatgaagaggcatccccagagacactttcattcataaactatcacatatggctaatgcaaagcactcctgccaaggacaaacccaagaagaaaaccagctcttcacatagatatccctagcccatgataataatagcatatctgaaaatgcggattggaaacaggttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatgg

SEQ ID NO: 134927 - DNA, 851 bp, Homo sapiens
  Payload ID: 6347
  Gene Symbol: FSHR
  Gene Name: follicle stimulating hormone receptor
  ENST ID: ENST00000454032
  CDS Start-End: 17-851
ggatggatgcataattatggccctgctcctggtctctttgctggcattcctgagcttgggctcaggatgtcatcatcggatctgtcactgctctaacagggtttttctctgccaagagagcaaggtgacagagattccttctgacctcccgaggaatgccattgaactgaggtttgtcctcaccaagcttcgagtcatccaaaaaggtgcattttcaggatttggggacctggagaaaatagagatctctcagaatgatgtcttggaggtgatagaggcagatgtgttctccaaccttcccaaattacatgaaattagaattgaaaaggccaacaacctgctctacatcaaccctgaggccttccagaaccttcccaaccttcaatatctgttaatatccaacacaggtattaagcaccttccagatgttcacaagattcattctctccaaaaagttttacttgacattcaagataacataaacatccacacaattgaaagaaattctttcgtggggctgagctttgaaagtgtgattctatggctgaataagaatgggattcaagaaatacacaactgtgcattcaatggaacccaactagatgagctgaatctaagcgataataataatttagaagaattgcctaatgatgttttccacggagcctctggaccagtcattctctctgagcttcatccaatttgcaacaaatctattttaaggcaagaagttgattatatgactcaggctaggggtcagagatcctctctggcagaagacaatgagtccagctacagcagaggatttgacatgacgtacactgagtttgactatgacttatgcaatgaag

SEQ ID NO: 134928 - DNA, 1698 bp, Homo sapiens
  Payload ID: 6348
  Gene Symbol: FSHB
  Gene Name: follicle stimulating hormone, beta polypeptide
  Uniprot ID: P01225
  ENST ID: ENST00000254122
  CDS Start-End: 70-459
acagctcttgccaggcaaggcagccgaccacaggtgagtcttggcatctaccgttttcaagtgaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaatttgtctacaaatatatttgtataaataaatagctcctttagaaagaattagccatgggggacgaggggaaactgctgttttctaggatcctgtctacatcaatcttctattttatccatccatgttctcccaaatctgtgctttctttcaacaggttatatattaaaactatttcatgagttgatttcttttaaacgtgttaactgtcttagttatgcactcagtttcacactcatattgtttaactaatttatttaaatcttatttttttaataaagatgctagccaccaga

SEQ ID NO: 134929 - DNA, 1890 bp, Homo sapiens
  Payload ID: 6348
  Gene Symbol: FSHB
  Gene Name: follicle stimulating hormone, beta polypeptide
  Uniprot ID: P01225
  ENST ID: ENST00000417547
  CDS Start-End: 40-429
acagctcttgccaggcaaggcagccgaccacagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaatttgtctacaaatatatttgtataaataaatagctcctttagaaagaattagccatgggggacgaggggaaactgctgttttctaggatcctgtctacatcaatcttctattttatccatccatgttctcccaaatctgtgctttctttcaacaggttatatattaaaactatttcatgagttgatttcttttaaacgtgttaactgtcttagttatgcactcagtttcacactcatattgtttaactaatttatttaaatcttatttttttaataaagatgctagccaccagagtcacaggcttggattgttttatgtacaaacagatgacttagatattctgtattttataatattagtggaatgaaatcttaaaatataattcccagtgtttctataaatattacctttccttatctttggagatattaaaaataattttgttggatttctgaagtgttttgtcacttaaatttcctgtcattttttgaagacattttctgatgtaatttggg

SEQ ID NO: 134930 - DNA, 1368 bp, Homo sapiens
  Payload ID: 6348
  Gene Symbol: FSHB
  Gene Name: follicle stimulating hormone, beta polypeptide
  Uniprot ID: P01225
  ENST ID: ENST00000533718
  CDS Start-End: 31-420
tgggcttcattgtttgcttcccagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaattt

SEQ ID NO: 134931 - DNA, 566 bp, Homo sapiens
  Payload ID: 6349
  Gene Symbol: FDCSP
  Gene Name: follicular dendritic cell secreted protein
  Uniprot ID: Q8NFU4
  ENST ID: ENST00000317987
  CDS Start-End: 113-370
ctccattccattatacctttgagtatataaaacagctacaatattccagggccagtcacttgccatttctcataacagcgtcagagagaaagaactgactgaaacgtttgagatgaagaaagttctcctcctgatcacagccatcttggcagtggctgttggtttcccagtctctcaagaccaggaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttcctagcgaaaagtaaacaagaaggaaaagtcacgataaacctggtcacctgaaattgaaattgagccacttccttgaagaatcaaaattcctgttaataaaagaaaaacaaatgtaattgaaatagcacacagcattctctagtcaatatctttagtgatcttctttaataaacttgaaagcaaagattttggtttcttaatttccacaaa

SEQ ID NO: 134932 - DNA, 3638 bp, Homo sapiens
  Payload ID: 6350
  Gene Symbol: FLCN
  Gene Name: folliculin
  Uniprot ID: Q8NFG4
  ENST ID: ENST00000285071
  CDS Start-End: 456-2195
ggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttttggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtttcactcttgttgcccaggctggagtgcaatggcacgatcttggctcactgcaacctctgcctcctgggttcaagcaattctcctgcctcagcctccagagtagctggaactacaggtgcccgccactatgcccagctaatttttgtattttttagtagagacggggtttcaccgtgttggccgggctggtctcaaactcctgacctcaggtgatccacccacctcagcctcccaaagtgctgggattacaagcgtgagccactgtgcctggcccttttttttttttttttttttttttttaaagagatggcatcttgctatgtcgtccaggctggtcttgaactcctgagttcaagcagtcctcctgcttcaacatacagctacaggtaccccccactatacatttttaataaggattcatggctcagagggattttctgatggttttgctgatttgtttctagtttttttgtgtttatatttaacatgaagaccaagtttatataactaggtatctgtataatgcaacaacattggaacacaataaagatgtatttttgtaaa

SEQ ID NO: 134933 - DNA, 1692 bp, Homo sapiens
  Payload ID: 6350
  Gene Symbol: FLCN
  Gene Name: folliculin
  Uniprot ID: Q8NFG4
  ENST ID: ENST00000389169
  CDS Start-End: 456-1484
ggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 134934 - DNA, 757 bp, Homo sapiens
  Payload ID: 6350
  Gene Symbol: FLCN
  Gene Name: folliculin
  ENST ID: ENST00000417064
  CDS Start-End: 299-757
cgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaag

SEQ ID NO: 134935 - DNA, 243 bp, Homo sapiens
  Payload ID: 6350
  Gene Symbol: FLCN
  Gene Name: folliculin
  ENST ID: ENST00000461699
  CDS Start-End: 132-243
gccccgtaagccagtccttccaggctcctgcctcctctggtcattccctgcgtgggcctctcgcaggaagcagttttcctgtgtcccccgccgaccccctgcaggaggcctgttgcagtctccaaggcaccatgaatgccatcgtggctctctgccacttctgcgagctccacggcccccgcactctcttctgcacggaggtgctgcacgccccacttcctcaaggggatgggaatgaggaca

SEQ ID NO: 134936 - DNA, 6388 bp, Homo sapiens
  Payload ID: 6351
  Gene Symbol: FNIP1
  Gene Name: folliculin interacting protein 1
  Uniprot ID: Q8TF40
  ENST ID: ENST00000307968
  CDS Start-End: 1-3417
atggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatatagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttga

SEQ ID NO: 134937 - DNA, 6366 bp, Homo sapiens
  Payload ID: 6351
  Gene Symbol: FNIP1
  Gene Name: folliculin interacting protein 1
  ENST ID: ENST00000307954
  CDS Start-End: 30-3395
ggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttga

SEQ ID NO: 134938 - DNA, 3845 bp, Homo sapiens
  Payload ID: 6351
  Gene Symbol: FNIP1
  Gene Name: folliculin interacting protein 1
  Uniprot ID: Q8TF40
  ENST ID: ENST00000510461
  CDS Start-End: 97-3597
atatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttg

SEQ ID NO: 134939 - DNA, 1720 bp, Homo sapiens
  Payload ID: 6351
  Gene Symbol: FNIP1
  Gene Name: folliculin interacting protein 1
  Uniprot ID: Q8TF40
  ENST ID: ENST00000511848
  CDS Start-End: 96-1622
tatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggtatgtaatctgacaactgttacactatgtattagacttttttgtagctatctgtaattattttatagcaaaaccaaaaataaataaaatgcttttacctcctgca

SEQ ID NO: 134940 - DNA, 6589 bp, Homo sapiens
  Payload ID: 6351
  Gene Symbol: FNIP1
  Gene Name: folliculin interacting protein 1
  ENST ID: ENST00000615660
  CDS Start-End: 863-3619
gccccgccccgcgcgccgtggccgtttgaagtgactaatttctgtcatatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactcggcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttg

SEQ ID NO: 134941 - DNA, 6925 bp, Homo sapiens
  Payload ID: 6352
  Gene Symbol: FNIP2
  Gene Name: folliculin interacting protein 2
  Uniprot ID: Q9P278
  ENST ID: ENST00000264433
  CDS Start-End: 76-3420
gcggccgccgcccccggctgcgcgctgagccgccggccccccgagcgccacggccggagctgcggcggcggcatcatggccccgaccctgctccagaagctcttcaacaaaaggggcagcagcggcagctccgcggcggcgtctgcccagggcagggctcctaaggaaggacccgcctttagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtctcagagcatcagcacccagaatgtaaggaactttggccgctcacttctggcgggctactgccccacatacatgcctgatcttgtgcttcatgggaccggcagtgatgagaagctgaagcagtgcctggtggccgaccttgtccacacagtccatcatccagtcctggatgagccaatagctgaagctgtctgtattatcgcagacacggataaatggagtgtgcaggtagctacaagtcagaggaaagtgacggacaacatgaaactaggccaggatgtcctggtctctagtcaggtgtccagtttgcttcagtccattttacagctctataagcttcacctccctgctgatttttgcatcatgcatcttgaagatagactacaggagatgtaccttaaaagtaaaatgctatctgaatatctccggggacacacacgagtccatgtgaaagaattaggtgtcgtactggggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttga

SEQ ID NO: 134942 - DNA, 724 bp, Homo sapiens
  Payload ID: 6352
  Gene Symbol: FNIP2
  Gene Name: folliculin interacting protein 2
  ENST ID: ENST00000504715
  CDS Start-End: 1-724
ctgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctaggtctgctgcaagcatgcagcagcaaactgctgcagggggtagctgaaggaggacctctccggctcacccggagtgcttctttctttgcagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatgg

SEQ ID NO: 134943 - DNA, 2173 bp, Homo sapiens
  Payload ID: 6352
  Gene Symbol: FNIP2
  Gene Name: folliculin interacting protein 2
  ENST ID: ENST00000512986
  CDS Start-End: 155-2173
gcttttctcacatactgtatagggagtgaaatgattgtttagaactgctggtcattacagaatgttcctcacataacaaaggaacttcaggatttgtctccaagtccatgtttatggtcaggataaaccagaagaacattaaaccgttcaggagatgtgcggcggcacagcgaacaccacaaaccagccagagagctggcaagactctgccagatgtgtgagtgatgctgttcctggtgctgggaggatttacagggcgcttttatgcacaaagattaaaaaacacaccggagtagacaggagcactgaccacacggaactcgacaacagttggtcatgttcggagtttgacctgaatgagattcgcctgatagtttaccaggactgtgacaggagaggcagacaagtcttgtttgactctaaagctgttcaaaagattgaggaggtgacagctcagaaaacagaggatgttcctattaaaatatcagccaagtgctgccagggaagcagcagtgtcagcagcagtagcagcagcagcatctcttcccacagttcttctgggggatcttcacatcatgctaaggaacagcttccaaagtaccagtacacaagaccagcttccgatgtcaacatgttaggggaaatgatgtttggctcagttgccatgagttacaaaggctccaccttaaagatacactacatacgttctcctccacaactgatgattagtaaagtcttctctgctagaatgggcagcttctgtggaagtacaaataacttgcaagacagctttgagtacatcaaccaagatcctaatttgggaaaactgaacacaaatcaaaatagtttgggtccttgtcgtactggaagtaacctagcacacagcacaccagttgatatgccaagcagaggacagaatgaagacagggacagtggcattgctcgatcagcctcactaagcagtcttttgatcacacctttcccatctccaagctcctctacatcttcttccagcagttaccagcgccgctggcttcgaagtcagacaacaagtttggaaaatggcatcatcccaagaaggtcaactgatgagacattcagcttggctgaagaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggctatgatctcctgtaggaaaatagcagaatcaagtctccgagtccagttttatgtcagccgtttgatggaagctctgggagaattcagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggg

SEQ ID NO: 134944 - DNA, 722 bp, Homo sapiens
  Payload ID: 6353
  Gene Symbol: FIGLA
  Gene Name: folliculogenesis specific bHLH transcription factor
  Uniprot ID: Q6QHK4
  ENST ID: ENST00000332372
  CDS Start-End: 6-665
ctgccatggaccccgcgcccggcgtcctagatccccgcgccgcgccgcccgcgctcctgggcaccccgcaagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcggataaaaaatctcaaccgtggttttgccagattgaaggcacttgtgccatttcttccccaaagcaggaagcccagcaaagttgatatccttaaaggtgcgactgaatatatacaggttctcagtgatcttttggaaggagccaaagactcaaagaaacaagacccagatgagcagagctatagtaacaacagttctgaatcacatacatcctcggcaagacagctgtcaagaaacatcacccaacatatcagctgtgctttcggcttgaagaatgaagaggaagggccttgggcagatggtggcagtggtgagccagcacacgcttgtcgccacagtgtgatgtctacgactgaaattatctccccaaccagaagtctggatagattcccagaagtagaactgctgagtcacagacttccacaagtatgaaaaatgaaaaggcccagggttaccttctagagacaaataaatgcagtcttgaaagtt

SEQ ID NO: 134945 - DNA, 2519 bp, Homo sapiens
  Payload ID: 6354
  Gene Symbol: FST
  Gene Name: follistatin
  Uniprot ID: P19883
  ENST ID: ENST00000256759
  CDS Start-End: 384-1418
gatttcgggcacctccgaaagataattgggaagggtttccagaaggtgggaaatgtcacctgattcacactgaacttttgaaagctccccacccccaaggagccgcgcacaccctcgctcgcggccgccctcccacagccccacacactgggagaccgcccaccgcaaaccgcggagacccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtgaaaaaataaaaaaattttaaaaagccaa

SEQ ID NO: 134946 - DNA, 2538 bp, Homo sapiens
  Payload ID: 6354
  Gene Symbol: FST
  Gene Name: follistatin
  Uniprot ID: P19883
  ENST ID: ENST00000396947
  CDS Start-End: 167-1120
gacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaaagaaaaagaaaaaaagaaaaatatattgtccatactgtaaataagtgtatgcttatttatttggggggaaaactatacattaaaggacctttgtcctaaagctctctcccaggccaccttgttactcattggacacggagaggcattcattgtgaggtctactggatgaggcccatagttgagacttgtagacatttatttatactgtgtcatgttttataatttatacataaaatgtctggttgactgtataccttgtttttgaagaaatttattcgtgaaaggaagagcagttgttatttattgtgaggtctcttgcttgtaaagtaaaagctttttttccttgtaaaccatttaagtccattccttactattcactcactcatctgtctcccttcatttcactgttagactcttttccactttcaacaaacttgcatgtcagtttctgtcatgtttatttattggattctctgctgcctgatctgtacatacatgatccctcgggttttgtttacaaggaaccttgactgaccaaaaggcattataactctgactcaaatacaaggtacagaagataagcatctttgaggaaactcctacttcagttcttttgttatgatgaagacatttgtgagagaggagatgattagaattctagtaatgtacttttaagatgttacagatacaaagaaatgatgtgggtgtcaggagactaaaggatgttgaaggctacacattcaaccttttgttaggtgtttcctttaagctactcagctgtaccttttaaattagttctttttcaaccagtatatcactaaaagttatatcaaagctttatcagttcaagtttcttgcttttcataatacttttttctgatgcaattttatattttcaaacatggcaagttaaaatataaattcatttaaatatatagttttgtacttttctaccatgtaaatgtgcaatgtatataaaagttataatgtgtatttgtaaataaatgatgagtg

SEQ ID NO: 134947 - DNA, 705 bp, Homo sapiens
  Payload ID: 6354
  Gene Symbol: FST
  Gene Name: follistatin
  ENST ID: ENST00000504226
  CDS Start-End: 1-648
ggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcacaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaa

SEQ ID NO: 134948 - DNA, 712 bp, Homo sapiens
  Payload ID: 6354
  Gene Symbol: FST
  Gene Name: follistatin
  ENST ID: ENST00000497789
  CDS Start-End: 1-308
ccagtgcctgccacctgagaaaggctacctgcctgctgggcagatctattggattagcctatgagggaaagtgtatcacaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgcaaaaaaaaaaaaaaaaaaaa

SEQ ID NO: 134949 - DNA, 5943 bp, Homo sapiens
  Payload ID: 6355
  Gene Symbol: FSTL1
  Gene Name: follistatin-like 1
  Uniprot ID: Q12841
  ENST ID: ENST00000295633
  CDS Start-End: 358-1284
ggcagggacccacgggacaccccctctgcctccgctccacgtccagggggccgaaggggcgccggacgagggaccgtgcggagagaggggttcggcggcgccaggactcccgcgggctccccggagcaggggtcggaaggagggggagcgggagccgcgggggccgctgcagcagaagggggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtggatttgagtttcaggagccttaaaaaggactgaagagtttctcctgggactacagcttggatggaaagtttactcggggactggtagaacaagtttctttgaaaggatcatggatagtgggtctggagtagaaggtgatgacaagtcagaaagtgtcttagtcccttcaagttgctataacaaaatgcctcagactgggtaattataggcaacagaaatgtattgctcacagttctgaaggctgggaagcctaagatcaaggtaccagcagattcagtgtctgatgacggcttgttgaagcttgcctgcttcaaagaatgcacctttttgatgcatccccacatggtgaaaagggtgaacaaactcccttaggcctcttttataagggcacttacccattcatgagggttaaactttgatgacctaatcatctcccaagagcctcacctctcaataccattgctttggggattcaattttaacatatgaattttgggggacataaacattcaaaccatagcaggtgcattcctgtattgggaagacattaaattaaatgactcgtaaatcccccatatgatttaggagactaaatggcatccagtgaggctgactgcagtagcctgtgagaaggcaaataaacatgggaaggtagtacagggaacatggaatcattgccagggacaggctaaataaccttaatggcacttccttgatacacacattccatgggggtaaacagttccaagtgggctgaacgttagctggttaaaacctcttttgcttggggacacatgactaacgctttccaacctgccattttcatatgtatcatgcactctccacccacaataattctgcctcccaaaagagcatattatagtcaatgaggtttaaggtttcttcggttcagtcatgtggaagttttgctttcctaaaattatagctggatcactttgattggatttgggatattacccaaatgctaatcaaatattaaaaggcaatcttttttgttatgtgattgctacagattactgctcttacagtttgattcttcaaattttcattctcagaagggaatcttaaacccagtttgaagggtaccttgtccacaaccacttttaaattttggctaacttcccaaccttccaccatgttctgggaaaactttttctgctgttatagtatgtatgtattcaggaagtgcaacattattaaactaagcataattcagaagctaagtttcctttcatcaaaatttaatattacgaattgtgcaaagaagtatgttactttgatcagctttattttagagcttctttatcaagttatcatcagtcctcttgaattatttctgaaataaggggaaggaaggaagggaaaaaatatgaatgcatagatagatctaagcagatgccttcagagccctggaataatcctagctgggatatgggacatgaaaacaactctggcctactgctgctgggggctgttgcatggtgtgacataggaagtaaaatgttgctgtatgaataggaaggagggtcttcctgtcaatgagaattaatgttttcctaatgatttaacttttttactgaaaaaataatatgtgtacatggtaaaaatccaaattgtatcacagaaaatacagtgaataaaaccatcctcttaagagggtgtgtacatttataaatttgcctatgattgcctataaagtcaaagaagttgcaccagtatgcatgactgccaaaagtacataaactgagcatatccatttccctacattcttgcaaacattgtgccttcgaactttttggcctctgatagaggaaaaatggtaactccttgttttattttttatattcattattccttttgtaagattaaatatcatctcatgaataa

SEQ ID NO: 134950 - DNA, 1396 bp, Homo sapiens
  Payload ID: 6355
  Gene Symbol: FSTL1
  Gene Name: follistatin-like 1
  Uniprot ID: Q12841
  ENST ID: ENST00000424703
  CDS Start-End: 96-917
ctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctctt

SEQ ID NO: 134951 - DNA, 807 bp, Homo sapiens
  Payload ID: 6355
  Gene Symbol: FSTL1
  Gene Name: follistatin-like 1
  ENST ID: ENST00000480823
  CDS Start-End: 1-61
cagcttccaagagtttctcaagtgcctcaacccatctttcaaccctcctgagaagaagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatatt

SEQ ID NO: 134952 - DNA, 565 bp, Homo sapiens
  Payload ID: 6355
  Gene Symbol: FSTL1
  Gene Name: follistatin-like 1
  ENST ID: ENST00000469005
  CDS Start-End: 147-565
ctccgaggctggcgatcggcggagctcccacctccgcttacagctcgctgccgccgtcctgccccgcgcccccaggagacctggaccagaccacggtcagcgcggggcccggcgccttcagactcgctctcttctctcttccgcagatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctc

SEQ ID NO: 134953 - DNA, 2542 bp, Homo sapiens
  Payload ID: 6356
  Gene Symbol: FSTL3
  Gene Name: follistatin-like 3 (secreted glycoprotein)
  Uniprot ID: O95633
  ENST ID: ENST00000166139
  CDS Start-End: 60-851
tatagggagcgccggccgcgcgctgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccattttggggtg

SEQ ID NO: 134954 - DNA, 746 bp, Homo sapiens
  Payload ID: 6356
  Gene Symbol: FSTL3
  Gene Name: follistatin-like 3 (secreted glycoprotein)
  ENST ID: ENST00000588773
  CDS Start-End: 225-347
agtgcgtaggggcggggcctccagcccaggacaggtcacatgggtggcggtggggcctgaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagc

SEQ ID NO: 134955 - DNA, 568 bp, Homo sapiens
  Payload ID: 6356
  Gene Symbol: FSTL3
  Gene Name: follistatin-like 3 (secreted glycoprotein)
  ENST ID: ENST00000591573
  CDS Start-End: 294-568
cacatgggtggcggtggggcctgagtaagggcgtctttatacttccgagggagtatcacggggtagggtcttttgtagggttgggatttggaaaatagtgggcctctgggggctcacactgggcaagagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggtgcagacgcagggcgggggcacaggcctgtcctgggggccggagaaccccctgccctgcgccctcaatgctcttatcgacccttgcaggcacccctgaggagccgccaggtggtgagtctgcagaagaggaagagaacttcgtgtgagcctgcaggacaggcctgggcctggtgcccgaggccccccatcatcccctgttatttattgcc

SEQ ID NO: 134956 - DNA, 2144 bp, Homo sapiens
  Payload ID: 6356
  Gene Symbol: FSTL3
  Gene Name: follistatin-like 3 (secreted glycoprotein)
  ENST ID: ENST00000592947
  CDS Start-End: 338-460
gctgccgcagtgcgtaggggcggggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccattt

SEQ ID NO: 134957 - DNA, 537 bp, Homo sapiens
  Payload ID: 6356
  Gene Symbol: FSTL3
  Gene Name: follistatin-like 3 (secreted glycoprotein)
  ENST ID: ENST00000589185
  CDS Start-End: 285-537
ccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtc

SEQ ID NO: 134958 - DNA, 748 bp, Homo sapiens
  Payload ID: 6356
  Gene Symbol: FSTL3
  Gene Name: follistatin-like 3 (secreted glycoprotein)
  ENST ID: ENST00000605925
  CDS Start-End: 227-349
cacatgggtggcggtggggcctgagtaagggcgtctttatacttccgagggagtatcacgggagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagc

SEQ ID NO: 134959 - DNA, 5419 bp, Homo sapiens
  Payload ID: 6357
  Gene Symbol: FSTL4
  Gene Name: follistatin-like 4
  Uniprot ID: Q6MZW2
  ENST ID: ENST00000265342
  CDS Start-End: 251-2779
tcacgggctccggtcccggcggcagaaatagggcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttacaaaaa

SEQ ID NO: 134960 - DNA, 716 bp, Homo sapiens
  Payload ID: 6357
  Gene Symbol: FSTL4
  Gene Name: follistatin-like 4
  ENST ID: ENST00000510685
  CDS Start-End: 246-716
ccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctggccccttgcgcttcccaggtgaggcaatgcctcgccctgcttcggctcgcgcacggtgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctggggccttgatcttaaggaggaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactc

SEQ ID NO: 134961 - DNA, 2660 bp, Homo sapiens
  Payload ID: 6357
  Gene Symbol: FSTL4
  Gene Name: follistatin-like 4
  Uniprot ID: Q6MZW2
  ENST ID: ENST00000621681
  CDS Start-End: 12-2033
gactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctc

SEQ ID NO: 134962 - DNA, 4831 bp, Homo sapiens
  Payload ID: 6358
  Gene Symbol: FSTL5
  Gene Name: follistatin-like 5
  Uniprot ID: Q8N475
  ENST ID: ENST00000306100
  CDS Start-End: 438-2981
tgcctagggaggaggagcgagaatcagcctggttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataagcaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacattttaa

SEQ ID NO: 134963 - DNA, 4757 bp, Homo sapiens
  Payload ID: 6358
  Gene Symbol: FSTL5
  Gene Name: follistatin-like 5
  Uniprot ID: Q8N475
  ENST ID: ENST00000379164
  CDS Start-End: 369-2909
gtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaaaaaccctacgatacaattattgaatgaagcgttttacaatacattgcacttaatccattgtttaaatttacaacttaactttccaagtttatatcctagtcaaacaaaatttacttggttggtccaaataaaataaattgtttttgactaagtgactaagacatacacaattaattatattggttaattagaaatactcagcacaatatttaatgagaaatcacatcagtcacaagaatcaaatatgtaaattatgctttaaacaataaagtaggatttaaatcatttaaaaaactaaactgcagggaatttcagatgacataaagcattatttcattttgagggtagtttattttttttctctgtccttttggtatgattaaacaagaaataaaaggtgttgtggaaacttaaaattcttaattcaaaatattcggtcctgtccactgtttataatattttgtgccttgaagggaatgtcacaggaggaaaaggaagactaaagcctgcatactaaatgctctcataactataaatctcttgttgttaaaaaacatctcttgcaccaaatcctgtcttcagtcttttgtttaaccctcaatgaactaccaattgaaggcataagttggtcttaggttgtatacaggtgtcaaactccacttgacatttactgtataatctgcagcatgctatagaaagtggggaggaagggaggaaaaataattacagtcaaaatatttgcaatctatctactcattttgctttcaatcactagagtgcattatgtttttaatgcaagtttgtctgggatgtcaactgcctacagatgtttattactagcagaatagattatttattaatagattgtttcttttcatatagtccaatgtttcatcatcaggaactttcggttttaaaaaagaaacattacttttgtctgctaaagtaaaccatatatagggaaattaacacctaggaaaagaaaactggcaagagaattgatgaggtattagtggcttagaagaattagtaatataagttgggaataaaggggtagcccgacagtggtaagtaaaaatgtagtactccattgtttttgctatttaaatataatgtatcaaaaacctttattctaaaatttccacaaatgattccttttatccatcttcttgtaatcctaaaagcatcttctcactatgtgctgtagtttgaaacctaacgaatcctcctacttgagacactgtagaaaagtaaaaattgttgcttctgttttgttttaagaggaaatgagaaggccagcagaagtagattaaaactagagagctggtttattaaaataagcagataattatccaggcttaaagtaatagcttacatgttttgaaaatccttgtacttatttttgtttttattgttgcaaaaaaatgttaatgggctgttgaaatgacctccatttacttaaggtaatccaataaggtcttttttaaatatacaaattttactcaagtttaaattgtataaaactgcttagaaacctgaaattttatagtgtgtaatatcttatgtgtatatagcatcctgagctgtgtgatacagtagatttcttcttagcagaaacatgcgaggtagatttaataaacaacaaaaatcagcttatgtttctacttattgaatctgctttactttttagcaattttcttccttgtgaacatgaaccatataaagtgtctgtgacttaatgatttcatgtaagtctgtcgcatacatccttcttttgtagcttacaccatgtggatgctctgtctgtagacactgcttgataaaaggagaataaacctcttacatttt

SEQ ID NO: 134964 - DNA, 2920 bp, Homo sapiens
  Payload ID: 6358
  Gene Symbol: FSTL5
  Gene Name: follistatin-like 5
  Uniprot ID: Q8N475
  ENST ID: ENST00000427802
  CDS Start-End: 407-2920
gttcagtgactgagacaaactggaggtgaaaggagctggtactgtccactgtgctgtcggtgctgaacctgagacgcgagcggaccagttgctccagcacctgaaggcaacgccctcttgcaccctctgtgccctgtgggacccgcttcaccaacaggacccatatcaacttgacaaaggagtgtggtatcggacgtgggagagagtcctctgtttgccacctgggcgctcattcaggcgtgactttggagatttctatagttttagaccaaactatttttttttccccagctaagacgatcttttgagagttttttttttttattgtgatttatatttccacagcgtttaggaatctttctgggggacttttgtgactgttaaaataaggtgaaaagcaataaggatgtttaagtgctggtcagttgtcttggttctcggattcatttttctggagtcggaaggaaggccaaccaaagaaggaggatatggccttaaatcctatcagcctctaatgagattgcgacataaggaaaaaaatcaagaaagttcaagagtcaaaggatttatgattcaggatggcccttttggatcttgtgaaaataagtactgtggtttgggaagacactgtgttaccagcagagagacagggcaagcagaatgtgcctgtatggacctttgcaaacgtcactacaaacctgtgtgtggatctgacggagaattctatgaaaaccactgtgaagtgcacagagctgcttgcctgaaaaaacaaaagattaccattgttcacaatgaagactgcttctttaaaggagataagtgcaagactactgaatacagcaagatgaaaaatatgctattagatttacaaaatcaaaaatatattatgcaagaaaatgaaaatcctaatggcgacgacatatctcggaagaagctattggtggatcaaatgtttaaatattttgatgcagacagtaatggacttgtagatattaatgaactaactcaggtgataaaacaggaagaacttggcaaggatctctttgattgtactttgtatgttctattgaaatatgatgattttaatgctgacaagcacctggctcttgaagaattttatagagcattccaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagacccgtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 134965 - DNA, 2278 bp, Homo sapiens
  Payload ID: 6359
  Gene Symbol: FPGS
  Gene Name: folylpolyglutamate synthase
  Uniprot ID: Q05932
  ENST ID: ENST00000373225
  CDS Start-End: 210-1823
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaag

SEQ ID NO: 134966 - DNA, 1383 bp, Homo sapiens
  Payload ID: 6359
  Gene Symbol: FPGS
  Gene Name: folylpolyglutamate synthase
  ENST ID: ENST00000373228
  CDS Start-End: 15-1142
ggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagc

SEQ ID NO: 134967 - DNA, 2279 bp, Homo sapiens
  Payload ID: 6359
  Gene Symbol: FPGS
  Gene Name: folylpolyglutamate synthase
  Uniprot ID: Q05932
  ENST ID: ENST00000373247
  CDS Start-End: 51-1814
gcggggcgtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaa

SEQ ID NO: 134968 - DNA, 2230 bp, Homo sapiens
  Payload ID: 6359
  Gene Symbol: FPGS
  Gene Name: folylpolyglutamate synthase
  Uniprot ID: Q05932
  ENST ID: ENST00000393706
  CDS Start-End: 68-1753
gattggctgggggcggggcggggcgtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactga

SEQ ID NO: 134969 - DNA, 959 bp, Homo sapiens
  Payload ID: 6359
  Gene Symbol: FPGS
  Gene Name: folylpolyglutamate synthase
  ENST ID: ENST00000431857
  CDS Start-End: 166-959
ggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacg

SEQ ID NO: 134970 - DNA, 677 bp, Homo sapiens
  Payload ID: 6359
  Gene Symbol: FPGS
  Gene Name: folylpolyglutamate synthase
  ENST ID: ENST00000423577
  CDS Start-End: 94-677
cagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagccca

SEQ ID NO: 134971 - DNA, 2160 bp, Homo sapiens
  Payload ID: 6359
  Gene Symbol: FPGS
  Gene Name: folylpolyglutamate synthase
  ENST ID: ENST00000630236
  CDS Start-End: 68-1195
gattggctgggggcggggcggggcgtctcccgcccgggcctagagcgctgccgggggcgccgggactatgtcgcgggcgcggagccacctgcgcgccgctctattcctggcagcggcgtctgcgcgcggcataacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactga

SEQ ID NO: 134972 - DNA, 2862 bp, Homo sapiens
  Payload ID: 6360
  Gene Symbol: FOXA1
  Gene Name: forkhead box A1
  Uniprot ID: P55317
  ENST ID: ENST00000250448
  CDS Start-End: 63-1481
cgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaa

SEQ ID NO: 134973 - DNA, 507 bp, Homo sapiens
  Payload ID: 6360
  Gene Symbol: FOXA1
  Gene Name: forkhead box A1
  ENST ID: ENST00000553751
  CDS Start-End: 139-249
ttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggagctggcgattaccctccaaaagtttaattaccattattgaaaacgcgtattggaactgccttggataatcttgggaagagggaaagaaaataaagccccaaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcgg

SEQ ID NO: 134974 - DNA, 2401 bp, Homo sapiens
  Payload ID: 6361
  Gene Symbol: FOXA2
  Gene Name: forkhead box A2
  Uniprot ID: Q9Y261
  ENST ID: ENST00000377115
  CDS Start-End: 183-1556
gctagaggggctgcttgcgccaggcgccggccgccccactgcgggtccctggcggccggtgtctgaggagtcggagagccgaggcggccagaccgtgcgccccgcgcttctcccgaggccgttccgggtctgaactgtaacagggaggggcctcgcaggagcagcagcgggcgagttaaagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 134975 - DNA, 2422 bp, Homo sapiens
  Payload ID: 6361
  Gene Symbol: FOXA2
  Gene Name: forkhead box A2
  Uniprot ID: Q9Y261
  ENST ID: ENST00000419308
  CDS Start-End: 186-1577
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacat

SEQ ID NO: 134976 - DNA, 1989 bp, Homo sapiens
  Payload ID: 6362
  Gene Symbol: FOXA3
  Gene Name: forkhead box A3
  Uniprot ID: P55318
  ENST ID: ENST00000302177
  CDS Start-End: 198-1250
ggagcccggggcgggcgagggcgggggtgtcccggctataaagcgtggccgcctcccgcggcgctcgggacagccgtaccccgggcggtcggacgggcgggcgccggtgggagctcgggccgtgcccgctgagagatccagagcgctccgttcccccggggccggagcgggggcgggtgggggcgtaagcccgggggatgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctagcaggggttgggaacatggtggtgggtatggctggagctcacaccacgaagctcttggggcctgatccttctggtgacacttcacttgtcccattggttaacatctgggtgggtctattacttactgtgatgactgctgtctcagtgggcatggtgttgatccacggggtactgtgataaccaccatggatacattttggtggcccactgggtactgtgaggactgctacattgatggatgttattggctaatccactgcatggtttgatggccaccatctcggttggccctttgggtgtgatggtgatagcatttcagtgacatcttctttggccccccccattaggtgctgtgcccacttcttttttggtgtacttggcacagtaggtgccaagttggccaccattctgtgtaacaccttttttggcccattgggtgctttgatggacatcatactgggtaggtgacaacgtcagtgggccaccatgtgccatgatggctgctgcagccccgtgttggccatgtcgtcaccattctctctggcatgggttgggtaggggatggaggtgagaatactccttggttttctctgaagcccaccctttcccccaactctggtccaggagaaaccagaaaaggctggttagggtgtggggaatttctactgaagtctgattctttcccgggaagcggggtactggctgtgtttaatcattaaaggtaccgtgtccgcctctta

SEQ ID NO: 134977 - DNA, 538 bp, Homo sapiens
  Payload ID: 6362
  Gene Symbol: FOXA3
  Gene Name: forkhead box A3
  ENST ID: ENST00000594297
  CDS Start-End: 234-538
attcccctttcttccgccacggtcatgcagggctctggctcttcgtcctctcctgccgagatgatgaagccccctgaggtagaaaggctccagagttctgacctcggggcccttggtatctgcagcgtcgctgcgggcagctccctcactcctgaatcacccccagctgtcgcgtcctggggctgcggcccccggcgcctgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccggg

SEQ ID NO: 134978 - DNA, 2957 bp, Homo sapiens
  Payload ID: 6363
  Gene Symbol: FOXB1
  Gene Name: forkhead box B1
  Uniprot ID: Q99853
  ENST ID: ENST00000396057
  CDS Start-End: 480-1457
aaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgagctcaagagcccaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaagatccgagcagtccgccggcccgcgcggacccagagcaagaagagggcgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgactcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccaccacctcactcgccttccctggctcccagtcctgccggcccccacctgggaccgccaccctaacttgttcatttcaccttcggccaacccgccttgccccaagagaactttgttttggacccaggagaccaaacacaaacttgcagatgggccgagaggcgcgtgggagttgtcctcgcccccacatcaaggaaggccggggccacctgagccgaaccatcccctccctgaggccccgaaaccccctcctatttgaccggcgggggaaaccctgtcaccccctcttcgccgagaaaagcgcgtcttccctccgcccagatcggcggagccccgaactctgcgcagtttcaagactagagaaactgcctcagatgtttccaggaacagatcccccccacaccccctccccgcgagggctgcaacagcgcaggggagggccggatctctttacgtcttggaaatctgcagcaaaaaggagccactaatcttcctaccccactcgcctccgcccatccggcaggggctgggccgaccacagcttcccggggttgcggccctgcctcctaggcttctgcggagattttgttgttgtttggggttttgtttccttccagaggctccaggcgctgggagttaggaaagaggctgccaagctgagaaagcgacgctcgtcctcacacagcaaaacaaaactaaaagtaaccttgtattgtttacaaagcgcccagtaatatgtaaacagtgaacttgaatctgtcttgctaggcggacgaacgggcaaagcccacattataagtacctgttgtaatgtgaatgtttactcttcatttctggccaggtttagaaagggagggaagtggggatgggaaagttaattgggatgttaactttccgatgacttagagacctttttagctatttattttattgttgggaaaaaaaaaaaaaaaaaagaaggaaagaaaatgaaataagcccaaaccaagaaagcatcaagggcaacccgggaagaacttagataagctgactggtaacatgaagggatgtcaccggatagctctcccacggacaagtctttctgtttgctaccagaacttttccaagaagctaaagggctgcaaagagatgtaaatacttgtgaataggaatgattatacactgtgtaaaatgcacttttgtttgctgtattcctttagaatcttagataattggctggaaaacgaactgttgttctggtgtgacctgcttaagttaaaaaaaaaaaaagttgtagtgtcatcagagctgtaaaatttttacctttcattttccctccctgtacagaattagcgtggcattttaaatattgatgttcttgttcccagcatgcctgttttaaaacaaaggatttaaaaaaaaagggtgtctacattaaattatgacctagtccaaataatattttctcattaaaatatgtaaattc

SEQ ID NO: 134979 - DNA, 1299 bp, Homo sapiens
  Payload ID: 6364
  Gene Symbol: FOXB2
  Gene Name: forkhead box B2
  Uniprot ID: Q5VYV0
  ENST ID: ENST00000376708
  CDS Start-End: 1-1299
atgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctag

SEQ ID NO: 134980 - DNA, 3926 bp, Homo sapiens
  Payload ID: 6365
  Gene Symbol: FOXC1
  Gene Name: forkhead box C1
  Uniprot ID: Q12948
  ENST ID: ENST00000380874
  CDS Start-End: 475-2136
cgagaaaaggtgacgcggggcccgggcaggcggccggcgcgcggccccccccccccccgccctggttatttggccgccttcgccggcagctcagggcagagtctcctggaaggcgcaggcagtgtggcgagaagggcgcctgcttgttctttctttttgtctgctttcccccgtttgcgcctggaagctgcgccgcgagttcctgcaaggcggtctgccgcggccgggcccggccttctcccctcgcagcgaccccgcctcgcggccgcgcgggccccgaggtagcccgaggcgccggaggagccagccccagcgagcgccgggagaggcggcagcgcagccggacgcacagcgcagcgggccggcaccagctcggccgggcccggactcggactcggcggccggcgcggcgcggcccggcccgagcgagggtggggggcggcgggcggcgcggggcggcggcgagcgggggccatgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 134981 - DNA, 2478 bp, Homo sapiens
  Payload ID: 6366
  Gene Symbol: FOXC2
  Gene Name: forkhead box C2
  Uniprot ID: Q99958
  ENST ID: ENST00000320354
  CDS Start-End: 86-1591
cgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagacaattaaggggctgcagagacgcaaaaaagaaacaaaacatgtccaccaaccttttctcagacccgggagcagagagcgggcacgctagcccccagccgtctgtgaagagcgcaggtaactttaattcgccgccccgtttctgggatcccaggaaacccctccaaagggacgcagcccaacaaaatgagtattgatcttaaaatccccctcccctaccaggacggctgtgctgtgctcgacctgagctttcaaaagttaagttatggaccaaatcccatagcgagcccctagtgactttctgtaggggtccccataggtgtatgggggtctctatagataatatatgtgctgtgtgtaattttaaatttctccaaccgtgctgtacaaatgtgtggatttgtaatcaggctattttgttgttgttgttgttgttcagagccattaatataatatttaaagttgagttcactggataagtttttcatcttgcccaaccatttctaactgccaaattgaattcaagaaaccgatgtgggttttgtttcctgtacaattatgagatataattctttttcccattgtaggtcttttacaaaacaagaaaataatttatttttttgttggtggataaagaagtcaagtatctgatactttttatttacaaagtgtgatggttttgtatagtaggttccaccctgagtattcctaaaagaaaaaaaaaaaaaaagcttaaaaactctaacttcatctgtgtttgtcttacgtggtcttaatcgttgtacttaccttaaaataaacccatgttgttttttctgcccaaa

SEQ ID NO: 134982 - DNA, 2107 bp, Homo sapiens
  Payload ID: 6367
  Gene Symbol: FOXD1
  Gene Name: forkhead box D1
  Uniprot ID: Q16676
  ENST ID: ENST00000615637
  CDS Start-End: 1-1398
atgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaa

SEQ ID NO: 134983 - DNA, 4675 bp, Homo sapiens
  Payload ID: 6368
  Gene Symbol: FOXD2
  Gene Name: forkhead box D2
  Uniprot ID: O60548
  ENST ID: ENST00000334793
  CDS Start-End: 2120-3607
cccttggtcagaggtcccagagggggcccaggcgacttcctctcaaaggacatgagtagtcagacctgccttccatttttttctgcccttaccttggggggatgaagaactctattttgaggattctgtgaaaagggttgcaacccaactctgttctatttctttgcaggagcctgggtgagttctttctccctatcctgggcctctgtagctccatctgtggaatgggagagttggattaacaccaggctatcccgtagattggaggctgctgttagatgaaactgcaaagtgttctcagtaccctttcctaaatggcctagaatatggctacacttatacatcagttctgaggtaggtgttactagcctcatttttacaaaggcagaaacaaagcgcaaagaaccttgcccaaggtgacagatagggtaagtagtgaaggcaggattggaaccccaggagcctgacttaaggtcgctgctcttaactactatgcagaccaggaaactgaggctccgaagcggggaagtcacctaatgagggtcacacagccttgctacagcggaggcagctgggattccggcctcgcacgcccgagctttagccactgtgcggcgctgtcggggcagcagcccaggcatccgctcagttcctgctcacgtccagcgcccatctccccttccgtgccccagaggctgaaatgggcccaatctgtgttgaagctgcttgtttctgggtcctggagggaggccgggggagaaagaggtctaataggatgggcaggaacccggctagcgagaaacaaggcacagggccaaccttagttgcacaagacttttgagagatgaaggcaacacttggtggaggtcagggttcactgagggggtgtcgggcagggggcggaggaggtcctgccgcctgtcggtggggcccagaaccctgggagccaggaaggtggggggtgtccagtcctcagggcaactggggccagggagaggggagggagaaattaagcggattcccagacccatgaacagacatccagacaaatgccgtttccacagagactcacggagagtgagatagtcacagagactgagacaaacggatgccgagatccagagggtcggagaacaggcaaactcggagcagtagaccggcccgcgccccgggaacgcggccacagcggccggcgctctgcccggcctctccgcgcggagaggggtggcgggcccgacagcggagggaggagagggcgccgccgcaatctcacctctcccaggcccaaggctgcgggcgccaagttcgctcctggtgatcactcgaatgcgtctcccctcgggctggaagccgtgcgggctcgggtgggcgccggcgggccgcgctggggcggcgtgggtcccggcgtctcagcctcgcgctcccactgcgcttcggcccggtggcccgggcgccgccttggggagaggacgggtggggaccgccgccacttccctggctgcggctggcgcccgagtgagccttaacatccaggggctgagcgttctgaaggcggcggcttcagggagcacagggtgcaggagcggcggcgaagacaagggcccgcctccggccactcgagcccagctcccgccgcggcggcggtttgttcccgccgggtccctcagcggaggcgctacgcccgcccctgtcgcctcgccccaccccgcccagggagctccgccctagcccgcagctcttccgccttaggcagccgctaggcgggagggacaatcccccaccaccaaccactgccaccccgaggggactaggggctgaggcccgcccaggtaagggaaagcctcagctccttccgttgcgccccagcggcgggtcccagctcggattcccggggtagtggcgggggccgccggcgggtcgtgccctggaaggtgagcgcggccgagctgggccgccagggggcgctgcggagccgggggacacccctccctgcctgcctcagtcccccgccccctccccgcccgcgcgcaaaacgcactcgccccagaggcagcgcggccgagcccgagccgctgccggagcggagccggagagtggcggcggcggcggcagcggcaccatgaccctgggcagctgctgctgcgagatcatgtcctccgagagctccccggccgcgctgtccgaggccgacgcagacatagacgtggtgggcggcggcagcggcgggggggagctcccagctcgctccgggccccgcgccccccgggacgtgctcccccacggccacgagcctcccgcggaggaagccgaggcagacttagccgaggacgaggaggagtctggtggctgctcggacggcgagccccgcgctctggcgtcccggggggcggcggccgcagcggggagcccggggccaggcgccgcggcggcccgcggcgcagcggggcccgggccgggaccgccgtcggggggcgcggcgacgcggagcccgctggtgaagccgccctactcgtacatcgcgctcatcaccatggccatcctgcagagccccaagaagcggctgacgttgagcgagatctgcgagttcatcagcggccgcttcccctactaccgggagaagttccccgcctggcagaacagcatccgccacaacctctctctcaacgactgcttcgtcaagatcccccgcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacgccttcgctttcgccgcggcagccgccgccgctccttgccagctgtcggtacccccaggccgcgccgccgcgcctccacccggacctccgacggcctcggtgttcgcaggcgcgggatcggccccagctcctgcgcctgcctcaggctcgggcccgggcccgggccccgcaggcctgcccgccttcctgggcgcggagctgggctgcgccaaagccttctacgcggcgtccctgagtcctcccgcagccggcaccgcggcgggtctgcccaccgcacttctgcgccagggcctcaagacggacgcgggcggtggtgcaggcggcgggggcgccggggcagggcagaggccttccttctctatagaccacatcatgggccacggtggcggcggggcagcacccccgggcgccggcgagggctctccgggaccgccattcgcggcagccgcgggtcctgggggccaagcccaggtcttggccatgctgactgctccggccctggctcccgttgctggccacattcgcctctcgcatcccggggacgcgctgctgtcctcagggtcccggtttgccagcaaagtcgccggccttagtggctgccacttctgaccgcagcaggcccagggccggttaggtccgcactcctcagcctctcccgggagttcctgcggtcccagcggaactcagggagtctatttatgaagtctccagaccttgggccggcacgcgtgacacggcacttcaggctccacgcacagaatctcgcagatagttgggactaagcgggctctatcgctcagggcgacaggcccggggctacgcgaagaagtcgcaggccaagattctttacagtttgagaaataaaagcaggggggtgggggcttcgtttttttccctgcctctgcgcctctcggggaacacattccgggagagatgcctggccaggctccacggatcccgccagaaacaccaacagagggtctccctttctgcctttcccctctcacttcttccccaacgttgagaccctgcttgtccaatattataatttaaagacatctattatctgctttgtgcttaaaagaaaaattcaacctttttttttttttttttttttttgctgttctccaaggaagttcgtttcctctgaagcctaaaccagtgtctacgcaggcggagctgaacggagaggtgaagcagggggtctttatattccctgcagaaaccctggatcccactccactgaggaaaatcctttctcttttgtgtttgggtgcttttaaaggaatttctttcctttcccttggctggctgggtccagccatctccggccagcaaccctgtcagtgttccaccctgtcccaggccctgtgatatttattgtggctaaaggcaatgagattgggtggaagagaagggtctgggccagggactggagaggtgggggtggagtgggcaagggcacaccctgtggcagggggtcctataattttgtgtaaatatctgtacagcgcgctgctctcggcgttctctgtccactgggtgtgcattgatttaaacttctccactgtggggaagctctgtgaaatcgtctgatggtctgtgtggaagaaaagaaaaatctgtctgccgcctatttcccattggtgtcgattgaataaatgtatgtgaacttca

SEQ ID NO: 134984 - DNA, 2086 bp, Homo sapiens
  Payload ID: 6369
  Gene Symbol: FOXD3
  Gene Name: forkhead box D3
  Uniprot ID: Q9UJU5
  ENST ID: ENST00000371116
  CDS Start-End: 19-1455
taccaaccccgaggagggatgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgcc

SEQ ID NO: 134985 - DNA, 1974 bp, Homo sapiens
  Payload ID: 6370
  Gene Symbol: FOXD4
  Gene Name: forkhead box D4
  Uniprot ID: Q12950
  ENST ID: ENST00000382500
  CDS Start-End: 86-1405
cattcatcccgggcttccagctcagcccgccggggccaggtgatccggccgccacatcccctgcgactgaagcacctgctccgccatgaacttgccaagagctgagcgccttcgctccacaccgcagcgcagcctccgggactccgatggggaagacggtaaaatcgatgtcctgggagaggaggaagatgaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccgagttcagggcaccgccaaggtctgcggcggcctctgaagatgcccggcagccggcaaagcccccctcctcgtacatcgcgctcatcaccatggccatcctgcaaagcccgcacaagcgcctcacgctcagcggcatctgcgccttcattagtgaccgcttcccctactaccgccgcaagttccccgcctggcagaacagcatccgccacaacctctcgctgaacgactgcttcgtcaagatcccccgcgagccgggccgcccaggcaagggcaactactggagcctggaccccgcctcccaggacatgttcgacaatggcagctttctccggcgtaggaagcgtttccagcgccaccaaccgaccccgggagcccacctgccccaccccttccctctacctgctgcacacgccgccctgcacaacccccgcccaggccctctgcttggggcccctgccccgccgcagccagtcccgggggcctaccccaacaccggccccgggagacgcccttacgctctgctgcacccgcatcctcctcgctacctactgctctcggcccccgcctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcggcatcaggaggaggactgcgccaacggctgcgctcccaccaagggcgcggtgctgggcgggcacctgtcggccgcgtcggcgctgctgcggtatcaggcggtggcagagggctctgggctgacatcgctggccgcccctttgggcggagaggggacctcaccagtttttttagtatcgcccacgcccagttccctggccgagtccgcagggccctcctagagccaggtgggagtggggagcgacccgcagctgctcactccaccttgcgcggcccatactgggcgtgtgcatctgaatcccgctggagagcaaacacgaacttctgttccctgcaaaatggttagaaagaaacagctggattacgttcctctaaaaaccacctgaacgtaaccttcgcagggcgtcaagtcatcttttcttgccttcggttgtggcttctgtggctttcccgatttgcacatgtcctggggtactatgaacgtgagtggggtattttgttctggcattaaaagaaaaacaagcaagcaaacaaaaacacagcctccgatgccaaacatgttcccccttcttcacttccttggaactggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacacta

SEQ ID NO: 134986 - DNA, 2491 bp, Homo sapiens
  Payload ID: 6371
  Gene Symbol: FOXD4L1
  Gene Name: forkhead box D4-like 1
  Uniprot ID: Q9NU39
  ENST ID: ENST00000306507
  CDS Start-End: 593-1819
acatacttttacggttacacattcctttacaaacaaccgtgtacatttcagcctcctgccccaccatttcttttctccaggagggaaggctgcatgtcgagatggtcgtagaatgttgagtatcctactttcctacctcgcttttatttgcgcgggtttaaatgcgccttaacagaacccgtgcaaaggcttgcctacttgtctggctgcaccggatgagtagagcatcttccttggtggcaggtgggtgcgaggaggagggggctgggcttttctccggacggtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagaggaaaacatcccaaagggtaaccactagcgttcctgcttcttgcaacattcatcccaggcttccagctcagcccgccccgggccaggtgatcggccgccacatcccctgcgactgaagcacctgctccgccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatggccatcctgcaaagcccgcacaagcgcctcacgctcagcggcatctgcgccttcattagtggccgcttcccctactaccgccgcaagttccccgcctggcagaacagcatccgccacaacctctcgctgaacgactgcttcgtcaagatcccccgcgagccgggccacccaggcaagggcacctactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccctgccgcagccagtcccgggggcctaccccaacaccgcccccgggagacgcccttacgctctgctgcacccgcatcctcctcgctacctactgctctcggcccccgcctatgccggggcaccgaagaaagcagaaggcgcggacctggcgacccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcagcatcaggaggaggactgcgccaacggctgcgctcccaccaagggcgcggtgctgggcgggcacctgtcggccgcgtcggcgctgctgcggtatcaggcggtggcagagggctctaggctgacatcgctggctgcccctttgggcggagaggggacctcaccagtttttttagtatcgcccacgcccagttccctggccaagtccgcagggccctcctagagccaggtgggagtggggagcgatccgcagctgctcactccaccttgcgcggcccatactgggcgtgtgcatctgaatcctgctggagagcaaacacgaacttctgttccctgcaaaatggttagaaagaaacagctggattacgttcctctaaaaaccacctgaacgtaaccttcgcagggcgtcaagtcatcttttcttgccttcggctgtggcttctgtggctttccggatttgcacatttcctggggtactatgaacgtgagtggggtattttgttctggcattagaagaaaaacaagcaagcaaacaaaaacacagcctccgatgccaaacatgttcccccttcttcacttccttggaactggaagtgttattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacacta

SEQ ID NO: 134987 - DNA, 2039 bp, Homo sapiens
  Payload ID: 6372
  Gene Symbol: FOXD4L3
  Gene Name: forkhead box D4-like 3
  Uniprot ID: Q6VB84
  ENST ID: ENST00000342833
  CDS Start-End: 86-1339
cattcatcccaggcttccagctcagcccgccccaggccaggtgatcggccgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagaatttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacacta

SEQ ID NO: 134988 - DNA, 2230 bp, Homo sapiens
  Payload ID: 6373
  Gene Symbol: FOXD4L4
  Gene Name: forkhead box D4-like 4
  Uniprot ID: Q8WXT5
  ENST ID: ENST00000377413
  CDS Start-End: 592-1842
acatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacatt

SEQ ID NO: 134989 - DNA, 3109 bp, Homo sapiens
  Payload ID: 6374
  Gene Symbol: FOXD4L5
  Gene Name: forkhead box D4-like 5
  Uniprot ID: Q5VV16
  ENST ID: ENST00000377420
  CDS Start-End: 833-2083
ctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggagtaagtggcaccgctccgaggtgggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcattgctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcactccagccggggctgcaggtggcccggtggggcggggttgcgcttccccgagagcacatcgagggcggcggcggcccgagtgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcgcacgccgccctgcacaacccccacccaggccctctgcttggggcccctgccccgccgcagccagtcccgggggcctaccccaacaccgcccccgggagatgcccttacgctctgctgcacccgcatcctcttcgctacctactgctctcggcccccgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaaggttagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatggaagggaggaagagtgtcctatatcatatttattgttcaacaaaacactgctccacggcttcaattcagtttaaaaaagagaatttattgaatatctaacacatacataaaaggcagtaaagacaaatgagaagaggggaggatattgaa

SEQ ID NO: 134990 - DNA, 2034 bp, Homo sapiens
  Payload ID: 6375
  Gene Symbol: FOXD4L6
  Gene Name: forkhead box D4-like 6
  Uniprot ID: Q3SYB3
  ENST ID: ENST00000622588
  CDS Start-End: 81-1334
atcccaggcttccagctcagcccgccccaggctaggtgatcggtcgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagagtttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcacttcaccttgcgcggcccattcagggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacacta

SEQ ID NO: 134991 - DNA, 3462 bp, Homo sapiens
  Payload ID: 6376
  Gene Symbol: FOXE1
  Gene Name: forkhead box E1
  Uniprot ID: O00358
  ENST ID: ENST00000375123
  CDS Start-End: 662-1783
cctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgtgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagtaaaaagaaaca

SEQ ID NO: 134992 - DNA, 1981 bp, Homo sapiens
  Payload ID: 6377
  Gene Symbol: FOXE3
  Gene Name: forkhead box E3
  Uniprot ID: Q13461
  ENST ID: ENST00000335071
  CDS Start-End: 245-1204
gggaaggggtgagtctgggtctgggaaaaactgatccaaaggcagaaagggaggggcgaaatggaggagggtaccgtgaacagagtaagggggctgggagaggaaattagaggggaggcgctggccagcaggcaaggcctgagccctctcccccggcggtggttgggggggggccgtgtccatataaagcgggtcggcggcccctgcggtcccggagccgcgcgggcaggggctgccgcagccgatggcggggcgcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccgcgagccgggcaacccgggcaagggcaactactggacgctggaccccgcggccgcagacatgttcgacaacggcagcttcctgcggcgccgcaagcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacagcctggtgaacctgcagccggagctagcggggctgggcgcccccgagccgccctgctgcgccgcgcccgacgccgcagccgcagccttcccgccctgcgctgccgccgcctccccgccactctactcgcaggtccccgaccgcctggtactgcccgcgacgcgccccggccccggcccgctgcccgctgagcccctcctggccttggccgggccggcagccgctctcggcccgctcagccctggggaggcctacctgaggcagccgggcttcgcgtcggggctggagcgctacctgtgagcctgcgccgcgcgggcaggcacctgtgcgacctgtgccccggacctgcggcgccgccctcgagcgccccatctctaccccccaccctggcttggagcacaccctgcgcctctcgtcgtggcctcctggactcaaactcctgctacatccttctccgtcccccatccctggggaggctcccaccatctcgccactggacagaagcgtcccctttgacctgccagcctctcatttcttctccctccacttgtgagcgcccccagctttgcggcgccccccaccccagcgctgtctgtgggtcccttgccccggagctgactcgcctccagtgagtccataccccaggtttcctggtgagttccaagcctttggaagccagatctgtgatcccaagccgcctcctccaccgactgtacttcatcaaccttctctcatgtttttccgacactcctgggtcagactcctgggttcatgacttacttgctagcgtcccttcattttcccacaagtttgccccccacctccacttacctgtctgccctcagcttcttcctgggagagagcccccctttcacgtagacacacctggctgccttcttcacgccctgaggacacttcttggagatttcagacaggcagcaccagggctcctgactgaaaggggagttggtgggcctttaggtctgccccatcccctggaaaacttaggacttattgggttattattatttttaattaaagctggtttaattaaaaagaaagaaacttttttctgga

SEQ ID NO: 134993 - DNA, 3516 bp, Homo sapiens
  Payload ID: 6378
  Gene Symbol: FOXF1
  Gene Name: forkhead box F1
  Uniprot ID: Q12946
  ENST ID: ENST00000262426
  CDS Start-End: 44-1183
gcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttattgggactgagattgtagaataccttccagactcccaaagatagaggggggaaaaaagaaaaaacaggctttggatctctagacgcttaaaaatttacaatctgggtgattctgagtacttttttcttttttggcaaatcctcctcttttcactcttcattccactttgaagtaaacgctggacaagaggaactatttttcttggcttctgttttttaagaagagccctttgcccctctaaatgtcattgatcgttttaaagaaataaacttttaaagaacactatagacctccttcccctagggaacaccaattaaaccatatatgtgcacatacatatggatatacatatatatgtatatacatatatgtacatatatgtatacgtgtccatgtacataatatatatttttttgccactacaagaccaatgagagttttactttgggtttccgactttcttgttctcttgctgtagctgttataaatcgtgaatcaactttaaggtttttttgtagttgttggtttgtcttgttttgttttggctttttggtgccttgttcttggttttccccgatagaaaatcaagcaaaatctaaatgaggcaaaagggcgcttggtgggccaggtgacaggcacctttccaatcctgtaacatttatctcctaagtcacagttcgtcctctctgggggaaaaatattttttaacacttgtaccttccactgaccaccctctttctattccagttcccggctaccgagaaaaacaaacacagtaagtcacattgttggtgcggtccttccagacccaccgcagtgtcttgcgtcgtggggtcgtgagtctctgaacctggttcttctcagagttgacattttggacgtgggggtaatttctccggtgctctgttacatcaaaattatcaataaactcgcctgggcaattagtgtccccaa

SEQ ID NO: 134994 - DNA, 2187 bp, Homo sapiens
  Payload ID: 6379
  Gene Symbol: FOXF2
  Gene Name: forkhead box F2
  Uniprot ID: Q12947
  ENST ID: ENST00000259806
  CDS Start-End: 115-1449
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataaca

SEQ ID NO: 134995 - DNA, 4890 bp, Homo sapiens
  Payload ID: 6380
  Gene Symbol: FOXG1
  Gene Name: forkhead box G1
  Uniprot ID: P55316
  ENST ID: ENST00000313071
  CDS Start-End: 1893-3362
ttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccccgaagtaaaggacacccccgcacacacgccagcggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagccggaaatgtgagctattggccctaggaggggaatttcggtggagcggagccggcggggtggagggggtggcgggggcgcagggaagggctgcggcaccgcgtgctcccgccggcgtatccctacgcggctccgcgcggcctcggggtccgaggcccgcggagagggggaggcgagcgcccgagggggcggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttgggagcgagggagcttcacccccggggcggtggttgtttcttttttctttctttcttttttcttttcctttttttttttttttctaattcctgaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttgtccttttctttaaagaactgtttttttttcttttgtttacttttagaccaaagattgggttctagaaaatgcacttggtatactaagtattaaaacaaacaaaaaggaaagttgtttcagttggcaacactgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacagaaataaaaaataggctaaattcatatatatcttgatacttttgtctcttttattaagtagagctaattttttaaagaccaatcaacttatagggaattcaaaggctttttcagccaaactaaaatttaaactgctcctttaatttgaactgactctaaaaatgaaaatagtatttttccctttgtgaacaaattttacaaggagcagcctatttaataaacactagctttaaacaaagtataggcttttcagctgatacctgtaagtttctgtggatatacagcaaaaagagatataatttaattttctgtgcatagctctttaccctgtgtttatttccaaatccattaatagaatgccatttatatattttgtttcaggtatattgttaatagagcttggcaaattataaataaatatatgtatatggttagatagaagtgactataatgcacacatatgtaatatatatagacacacagagcccttcagttcaggtacaatttgcgctatgaatgctgcaaacatttttgtttaaatatttgtatttatactttctaagtcagcatttatttttgtggctgtttacccacaatgaaagagttctaataaagatgtgctgaagttgcaatata

SEQ ID NO: 134996 - DNA, 2503 bp, Homo sapiens
  Payload ID: 6381
  Gene Symbol: FOXH1
  Gene Name: forkhead box H1
  Uniprot ID: O75593
  ENST ID: ENST00000377317
  CDS Start-End: 580-1677
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagacccca

SEQ ID NO: 134997 - DNA, 1990 bp, Homo sapiens
  Payload ID: 6382
  Gene Symbol: FOXI1
  Gene Name: forkhead box I1
  Uniprot ID: Q12951
  ENST ID: ENST00000306268
  CDS Start-End: 62-1198
gtcaggggcagctccggggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctatggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccgggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgt

SEQ ID NO: 134998 - DNA, 2011 bp, Homo sapiens
  Payload ID: 6382
  Gene Symbol: FOXI1
  Gene Name: forkhead box I1
  Uniprot ID: Q12951
  ENST ID: ENST00000449804
  CDS Start-End: 46-897
gggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctatggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccgggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaaca

SEQ ID NO: 134999 - DNA, 3217 bp, Homo sapiens
  Payload ID: 6383
  Gene Symbol: FOXI2
  Gene Name: forkhead box I2
  Uniprot ID: Q6ZQN5
  ENST ID: ENST00000388920
  CDS Start-End: 40-996
ggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaaaggcaattactggaccctggaccccaactgcgagaagatgtttgacaacgggaacttccgaaggaagaggaagaggagagctgaagccagcgcggccgtgcgctcgggagccaggagcgtgggaggggccgaggcgccagcgctggagcccccgagcgcggcttgcctggacctgcaggcctcgccctctccatccgcacccgaggccgccacctgcttctccggtttcgcttctgctatgagcgctctggctggcggccttggcaccttccccgggggcctggcgggcgacttttctttcgggaggcggccaccgacagtcgccacccacgctccccagacccttaacccctcccctggcttcgcccctggccaccagaccgcggccgccggcttccgcctcagtcacctcctctacagccgggaagggaccgaagtttgaagggaggctggaggctagccgggtgcgggtccagaggtgctgagctcaggcctccggtttcccctggtgacagccccacgtgttggcgttgaaggccttggtgccctgggaggaagcgcagagccgggggcggctcggccagcagggagctgggctgagcggctcttgggctttggggtgggtggcccttctgctgtgcacccctcacccaggcgaccttcggaacctccctgctctgcctctaagtccagccgccctgggcgtctagaacctgtgctctcgagggatttgccttgaaggggcggcgggtcggccctcagctccagcgttttccaaggaggctggctgactccaaagagccttagagcagatgggaagaaggtgggctgccagagcggcccaggtggtgggggccctttccacctccacccagcttggcccacctggctcagggccttcccttctgcttcagggaagctgccgcaggggctgggggacagagctcaggagcagctgcagtgggctccaggtgggccaggagcctgcagtgaggggatctgagacagttggcattgggtcctgtgtaaggaaggtcttgctaatggttggaactgctggtggtgggagggagaagcactgcgtgggcagaaagcgcccttgggataccagctcccttccctgtcactcagccctggtccttgatgacccccctctaggacaaggcaactccccagggccccgccaccactgaccacaggagcggtgcccagcacccaggagttccccaagggtccaggtttgtgccacccacacccacactcacacccacactcacacccacactcacacccacacccacacccacacccacactcacactcacactcacacccacactcacacccacactcacacccacacccacacccacactcacacacactcacacccacacccacactcacacccacacacactcacacccacacacacccacactcatactcacactcacacccacactcacaccacacccacactcacactgacacccacactcacacccacactcacactgacacccacactcacacccacactcatactcacactcacacccacactcacactcacacccacactcacaccacactcacacccacacacacccacactcatactcacacccacacccacactcatactcacacacccacacccacacccacacccacacccacacccacacccacactcacacaggctcatggaaggccacacttgttttggtctctttcccctccaaacccacagtttgagccaaagctgtgcgtgtgttcagagctcctgaacagcagcctcctgtgtaaattgaaccctgccccacccagttccttcttagggatggtatctttgtgaaggacaaggagcccccagtcactgggaagaggaattttttggcctctgtactccttagaggacctaagtgccccagtcagatgccctgagtctttgtggcatctgggactccctggagatggagacgttggtggggggggggtacccaccttgttgttgatgggggtacctatcttccctgcattttgggggagggtgggaggggtccttcccaggaagagagtggagacaggttactgttactttggagtgggacaggctggtttagcaatcctaagccccagccacgcaggtattcctgatctgcctgcagggcccctcactgcagctgccaccagtgctggaaatgagagcagggctcctgactgtccctagagctgactcatcatggccctgctgaagagtgaggtgtgtgtgtgtgtgtgcgtgtgtgcgtaagacagagagggagggagaaggaaggaggcgggggaacatggagagaaggagccaggagttgggataaacctggccctggtcatatgtttcatcagcagtggctcctaactccacgtgccatctctgctgctgccctccacaagcaggtgagcagagtgccagttgtgttgaaggtgatgatgtcgcctaactaaactcacaaccaacccgcaatctctcttggggggacactccccataagcaatacaattaaagaagaccaggaaaggaaaataaattccttagcttatacatttaaaaagtatcccttgaacctattttaatagaatgaaatgctaaaaataaagaccaatataacatacat

SEQ ID NO: 135000 - DNA, 2804 bp, Homo sapiens
  Payload ID: 6384
  Gene Symbol: FOXI3
  Gene Name: forkhead box I3
  Uniprot ID: A8MTJ6
  ENST ID: ENST00000428390
  CDS Start-End: 122-1384
cagcgcgggtgaaggcggagccgcagggttggcccccaaagggatgctctcgcccgagcggcgagaccagccccgctcgcccctcgccgcggccgcgccgcagccgcccacggccgccgacatggccctctactgcggcgacaacttcggagtgtattcgcagcccggcctgcccccgcccgccgccaccgccgccgccccgggcgcccccccggcagccagggcgccttacgggctggccgactacgccgcgccgccggccgccgccgccaacccctacctgtggctcaacgggcccggcgtgggaggcccgccctccgccgccgccgcagccgccgccgcgtacctgggcgctccgccgccgccgccgccccccggggccgcggccgggccctttctgcagccaccgcctgccgccggcaccttcggctgctctcagcggcccttcgcgcagcccgcgcccgccgcgcccgcctcgcccgccgcgcccgcggggcccggggagctgggctggctgtccatggccagccgcgaggacctgatgaagatggtgcggccgccctactcgtattcggcgctcatcgccatggccattcagagcgcgcccgagcgcaaactcactctcagccacatctaccagttcgtcgccgatagcttccccttctaccagcgcagcaaggccggctggcagaactccatccgccacaacctgtcgctcaacgactgcttcaagaaggtgccccgcgacgaggacgacccaggaaagggtaattattggactcttgatccgaactgcgagaaaatgtttgacaatgggaacttccgtcggaagcgaaagcgccgctctgaggccagcaatggctccacagtggctgctgggacatcaaagtccgaagaagggctctcctcaggattggggtctggagtgggtgggaagccagaagaagagagcccctccactctgctgaggccttcccactccccagagcctccggagggcaccaagagtactgcctcatctcctggaggacccatgctcacctccaccccttgtctcaacactttcttcagcagcctcagctccttgagtgtcagcagcagtgtgagtacccagcgggctctccctggcagccgccacctagggatccagggggcccagctgccctccagcggcgtgttctccccgacctccatctcagaggcctcagcagacaccttgcaactgagcaatagcaccagcaatagcaccggccagagatcttcctattacagccctttccctgccagcaccagcggggggcaaagcagccccttcagcagccctttccacaactttagcatggtgaacagcctcatctacccccgagagggctccgaggtgtagagcagactctcagacttgagtatgcacacctgaggcgtgcacacatgctgattagaatgcagattccaagtcagtaggtctggggtaggacctgagttctgcgtttctgtcgagttcctgggtgatctcgtggtcctttgaccacacttggagtaatgagggtgtagtagataactcttgctacaacccagcgagcttttacaggtttctctgcatgtgggcctctccagagagaaatccgtttcactgtcttctgtgataggtagcctgtgagccccgtgagggcggggaccatgtctattttgtttatcactgtatgccaggattgcaagctcaagtgtgtacagatggctaaaaaaacacaagccaacgaagttactgggtgagaaaactaacatcagttggcaactgaagcagtagagggtagttgggactgactagtagaaggctgctgggaacagctggttctttctctcctctggcagcattctgattttgtttttttggttttttttgacacagtctggctctgtcgcccaggctggagtgcagtggtgctgcaacctccgcctcctgggttcaagcaattctcctgccttagtcttccgggtagctgggattacaggtgcctgccaccacatccagctaatgttttgtatttttagtagagatagggtttcgccttgttggccaggctggtctcaaactcctgacctcaggtgatccacccgcctcggcctcccaaagtgctgggattacaggtgtgagccactgcgcccagccagcattctgatttttatagaagagccagatatctgaatttttataggaaacctccaactttgtgtcatttgcctctgaagatttttttttggttgtttatcatactgtcctaggcaacaccacaaatccttgagctatgcataggcagctcacaaatcacctctgtctggtacatggtatattctaatggcaataaaatggcacaagcagccttgtgtgccaggcactgttctcggcacttgtcatgtattcatttaatcctctcagaaaccttgggtggtgggtattgttactaccccccattttccatgtaagggaagtgaaacttcaggatgttaggtcactttgtctattttagtcatcactgtataccaggattgcaagctcaaatgtgcacaggtggctaaaaaaaagttgtgaccactttccaaggtgagactgatagtaaactggagccaggatcagacccagacaatctggttccagagctggtgcttgtaacttctgtattctacttcctgcaaaaccaagaaaccagcctccatagccagttataagtatatagagggaaggaatggagctagatctcatttgaccaaagattctagttgaaaataaaagtcatctggtgtgttcc

SEQ ID NO: 135001 - DNA, 2641 bp, Homo sapiens
  Payload ID: 6385
  Gene Symbol: FOXJ1
  Gene Name: forkhead box J1
  Uniprot ID: Q92949
  ENST ID: ENST00000322957
  CDS Start-End: 356-1621
aggagaagcctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaa

SEQ ID NO: 135002 - DNA, 5523 bp, Homo sapiens
  Payload ID: 6386
  Gene Symbol: FOXJ2
  Gene Name: forkhead box J2
  Uniprot ID: Q9P0K8
  ENST ID: ENST00000162391
  CDS Start-End: 1146-2870
ggagccggggcctgcagcggagccgagccgagcccgagcccgcgccgagccctgacactgtctgcccgccttctggctccccgggagcccagactggtcggagcccgagcggtggcagcgcggggagccccacgcgccgaagggagcggacccgacaggacggccctagaggaggtgctgccgccacagtagcagggaccggagtctcgagccgcggcctcccggaccgtgctgcccaggccagctcagggacagccgggagtacgaaagccccaccctctggggcaccccgggagcggaggcgggagcggggacgcgagcaacctctccccctgttggagagaaaagacccttaccactcgggtgagggaaagaagagacccctggaggggacgcctctctcctgcctagaggcgaggaagacccctgtactggccggggaggagacccccagaagtggaaagaagggagctttccgtagggaagcagagtgagaccaccctagcgcgcccccgcccctccaaacacacactctcaacagttcaggactttggaggcaaagagagacggggctgtgcctgtggagtaggcaccctcggcccaccactattcacaggagacaggagtccttacgttcagaagccactccagggaaagaagaggaatcggctttcagccttctggagaggggaagacctccccctcaacttcctcgtgcctagacagtggaacggggtggagcccctccgctcctatctccagcagacagaaagagccctccacctcagaaagatccagtttgggggggaggggaactcccccaagggggaggagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaagtgaactcttatgggcacccacaagctccccacctctaccctggcccatcaccaatgtacccaatccccacccaggactcagcaggatacaatcgcccagcacaccatatggtccctcggccatcagtgccacctcctggtgccaatgaggagatccctgatgacttcgactgggacttgatcacttagtgcatcacagagtgtggacatcagcccagggccgcgtggtgaaatctggcagtggggaaagagcaaccccagcccgtcccttccccccgtctgtatatagacatatatcctctttttgttctttctctgtcagagaagccactgcaagatgctgccgaagataaccctctctttcctgcctcattcttctctcttccttcctgttttttcctagttcttttattattattcttatattattattattattattggttatatactgtccatagtctcctgtccctacatcatggatcatgtccaccttttgctaatttaaaatcatcaggctggaagatgaagccatgatagctacagagaaaggttttagactccagtttacctttctcttggagaaactcaatgctaatcccaccttttggccctaaattgttttttgttcccatcagtttcaggccaggactggagaggccacattaccaagtagaaagggtctgaaacattacttggcagccaagaatttggaggttttaaaatggtgctaattctgtcctctgaggtcttccttgtccctttataccttcaatccttacttctgccagtctgtatttcctatcaagggtgaaagtgatgatggtggtgcaggagggtgacaataaaatcctagtggaattggagaccattggaagggatggaatataagtcagtgtgaaactgagtatacactgccatgttacatcagtgtccattggcttgttttgagcctgttctctaagaagataggattggttttagcccaaactctgcttctatggtagggcatgaggacaactattcagcatggttttagcttcttggagatgattccaacttaactattttggctttttaaacataattttctctgaaaattaattgtggctcttatttgcatttacgaatgatcttcccatccctttttcccattcagcaaatattagtttgtcctcctttaattgtttgcccaaatcttccacccatcttttttcttccctcattttctgggattctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaaagaa

SEQ ID NO: 135003 - DNA, 2676 bp, Homo sapiens
  Payload ID: 6386
  Gene Symbol: FOXJ2
  Gene Name: forkhead box J2
  Uniprot ID: Q9P0K8
  ENST ID: ENST00000428177
  CDS Start-End: 489-2069
aagaggaatcggctttcagccttctggagaggggaagacctccccctcaacttcctcgtgcctagacagtggaacggggtggagcccctccgctcctatctccagcagacagaaagagccctccacctcagaaagatccagtttgggggggaggggaactcccccaagggggaggagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaaggtactgcaccaagccagttgccatggaggtggagactatgttgaaaaggaagcataggagaaaggcaaaagagaactgagagaaaggattttatggggcagtgacccaaattgagcagtggaactagtttatcagttgactgaatatctgttgaatcagtgaagtcctaaactgaaaaatgcaaaagaaatagactgtatgattcctttttagacctcagtttgggagatcagaattgtttaagaaaagggaggagatttgttagagaaaggctgtattttaaatttgcgtctcagtaatccctaccgcctgggtgataccggatgaaatggtggttctatgcttatgtgatgttcaaactagtgaaatgagagagatgtcatgattatgttcctgtttcttgctttttgtttttgagatggggtctcgctctgtcgcccaggctctggagtgcagtggtgtgatcacggctcactgcaaccttgacccctggagctcaggtgatcctcccactttagcctcctgagtagctgggactacaggtgtgtaccaccatgcccagctaattttttttttgtattttgtgtatagctggggtttcaccgtgtcgcccaggctatcttcaaactcttggactcaagggatctaccc

SEQ ID NO: 135004 - DNA, 5106 bp, Homo sapiens
  Payload ID: 6387
  Gene Symbol: FOXJ3
  Gene Name: forkhead box J3
  Uniprot ID: Q9UPW0
  ENST ID: ENST00000361776
  CDS Start-End: 175-1941
cccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctattt

SEQ ID NO: 135005 - DNA, 5225 bp, Homo sapiens
  Payload ID: 6387
  Gene Symbol: FOXJ3
  Gene Name: forkhead box J3
  Uniprot ID: Q9UPW0
  ENST ID: ENST00000361346
  CDS Start-End: 192-2060
agttccgggtgcgcggccccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctattt

SEQ ID NO: 135006 - DNA, 4468 bp, Homo sapiens
  Payload ID: 6387
  Gene Symbol: FOXJ3
  Gene Name: forkhead box J3
  ENST ID: ENST00000372571
  CDS Start-End: 887-1297
gggaaaatacagatttgtgtggcatttcctatctgttcatttattggtactgtaatgtaaagagcagtatcaagtttgatattactaggtgatgtggcaatttggaaactgctagactggaggttagaagacctgggttcaagtcttagattcatcatgataaccttgctaagttatgtcacttctctggttcagtttcttttatttgtaaaatggagagaaataatacctttctgcctgtctcacagagcagattgcccaacacgtgatataatgggtacaaatccccttgtaagacgggacaagaatcagccaatttcaggaataagggcagctcatcgttttcccttaccacacttcaccctttcaccatccaggaattacactgttgtcaatattttataggtgtttcaaatgattggtatgcgacacttgatatgctaaaagaaagctgtcgaattgccagcagtgttaattggtcagatgtagacctttcacagtttcaaggtgagtgttggttctttttgacatataaccaaatacacatgatcctgtttctctgctagattataactttctttgtagtagaaataaacatcatcttatatagcatttcttttgcagttggtaaaattcataataattttggccacttggtatagcagagggtcacagacaagttctgaaagaaatttgaccacatttaaaataattgggctttgaataatttaaaaaggtcattcttcattgcgtggataaatcactaccataaagtggagtgagtggaaattttgagagctgaaaaaaattatgtcttgctattttccttgcaatgtttattgcataacagtgctaacatatttttaatgctttcctcataggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 135007 - DNA, 5352 bp, Homo sapiens
  Payload ID: 6387
  Gene Symbol: FOXJ3
  Gene Name: forkhead box J3
  Uniprot ID: Q9UPW0
  ENST ID: ENST00000372572
  CDS Start-End: 313-2181
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagtttagtatgagatcattttcccttgcctgagttttgagctgattgagaaataagaacctacagatgaagaagcaagacagtacctttaaaaaaattagctttttattcagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 135008 - DNA, 5309 bp, Homo sapiens
  Payload ID: 6387
  Gene Symbol: FOXJ3
  Gene Name: forkhead box J3
  Uniprot ID: Q9UPW0
  ENST ID: ENST00000372573
  CDS Start-End: 270-2138
ataacctgggtagctaccttgagaattagaagggcctttagaggtccaactcctttaagaaagaaagaaagaccaggcacgggaaaggcctccgcagacatgagtctagcacctgggactcatgaagttctgaaaagaggggtgtcctgaaggtccaaggcgcctttgttgggggtcccggaatccgcggtgtgccaggtcggaaaaggcgtccgctttcctggagaggaggctaaggtgccgggcgcttcgattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 135009 - DNA, 447 bp, Homo sapiens
  Payload ID: 6387
  Gene Symbol: FOXJ3
  Gene Name: forkhead box J3
  ENST ID: ENST00000422278
  CDS Start-End: 188-447
tagaagagatttcactagtgatttaaattcattttcagaaacaaagcacaaaactggatgttcaagaatttgatgagatcccttcaaactgtgttaaagttgctggatatatgagctaataattatttattttgttcttgtattttaggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttcc

SEQ ID NO: 135010 - DNA, 1326 bp, Homo sapiens
  Payload ID: 6387
  Gene Symbol: FOXJ3
  Gene Name: forkhead box J3
  ENST ID: ENST00000445886
  CDS Start-End: 181-1326
cgcggccccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccag

SEQ ID NO: 135011 - DNA, 499 bp, Homo sapiens
  Payload ID: 6387
  Gene Symbol: FOXJ3
  Gene Name: forkhead box J3
  ENST ID: ENST00000454417
  CDS Start-End: 1-378
gctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggtaggattcatcttcttaaaacagttgaattcttcagtatgtcacttgtcatgtttgaattaagaacttttccagttcattgaataggaacctctgcaaaatagtaagtcctcccccaccctgctctaaagcttgttagagagttttaagctgtgggaacctaactagtgtatagctgttgcac

SEQ ID NO: 135012 - DNA, 5165 bp, Homo sapiens
  Payload ID: 6387
  Gene Symbol: FOXJ3
  Gene Name: forkhead box J3
  Uniprot ID: Q9UPW0
  ENST ID: ENST00000545068
  CDS Start-End: 132-2000
acagtttagtatgagatcattttcccttgcctgagttttgagctgattgagaaataagaacctacagatgaagaagcaagacagtacctttaaaaaaattagctttttattcagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctattt

SEQ ID NO: 135013 - DNA, 11181 bp, Homo sapiens
  Payload ID: 6388
  Gene Symbol: FOXK1
  Gene Name: forkhead box K1
  Uniprot ID: P85037
  ENST ID: ENST00000328914
  CDS Start-End: 1-2202
atggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccacattgatctgctgttttcaattggaaccatttctcctgcctgaaactccagggcccctccctgggctgtccgtgagcaggagaccccaccccagcagcagtggtgagcaggcctgtgcctccacgcccagcccccgccaacgcgactggttttgtttgccacacggtgagaaccggaggacgggatgctccagccagttgggtggttctggggtccctgaggaagccccctcctgcacttccattaagacagccagtggttcctggatctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagtgcctgaggagcagtggttcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagccaggacccaagaaccttctctaggttctcaagggtgagctgacccgggcaatgtgcaggaatgtggggagcaaaagtagctgattccagccccgttctggggtcactggggaggcagaggctgagggcctgttctctggtcaccagggactgggggcacggtccacagcggatgagaacagcaggtcacagtagtggctttgggaagggcccctcctgctttgccctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgtcaccactttttttttttttgagatggagtctcgctctatcgcccaggctggagtgcagtggcccaatctcggctcactgcaacctccgcctcccaggttcgagcgaattctcctgcctcaacctcccaagtagctgggattacaggcacctgccaccacacccggctaatttttgtatttctaatagagatgagagtgttaccatgttggtcaggctggtcttgaactcctgacctcaggtgatctgcccacctcaacctcccaaagtgctgggattataggcatgagccaccgcgcctggcctctgtcactttttttgctccttacccagtttttgttttttgttgttttgttttgttttagcgtgatactacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgtttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcacctgaggagtttgagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcaacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 135014 - DNA, 758 bp, Homo sapiens
  Payload ID: 6388
  Gene Symbol: FOXK1
  Gene Name: forkhead box K1
  ENST ID: ENST00000460979
  CDS Start-End: 1-328
cacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggtctgagcccacctggcgccgtggtgcacctggtgacccaggatcgggccatagtgacccggcgcgggcggcacagacagcccagggcctgcgggcgtgtgctcgaggtggtctcagcccacagggaatggagccgcagctggcggtagagccgtcggccctttctcgttttcgtgcccaaatcatccccgttggtcatttgctggtgacaggggtggcgccgtcaccgagggcccctcccgccacgctccttgttcatctgccgctggcagcccggcgtcaaagccttcatacagcccttgagcaggatggcgttctccttataactttgtcttagttcatttttgtccaatagctgttttcaaattgatttctggaagaggtgagaaatttcagaattaaattataataaaaccgaagttttccttcccatgag

SEQ ID NO: 135015 - DNA, 5265 bp, Homo sapiens
  Payload ID: 6389
  Gene Symbol: FOXK2
  Gene Name: forkhead box K2
  Uniprot ID: Q01167
  ENST ID: ENST00000335255
  CDS Start-End: 175-2157
cggccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacctgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgttttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaataaaatatttttattaattttaatggaa

SEQ ID NO: 135016 - DNA, 786 bp, Homo sapiens
  Payload ID: 6389
  Gene Symbol: FOXK2
  Gene Name: forkhead box K2
  ENST ID: ENST00000526383
  CDS Start-End: 26-786
gcttcgtgtgcagagcccagcagagatggcggagccacttggcatccaagcaccttgccctgtttgtgtccacctggttctgccgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcc

SEQ ID NO: 135017 - DNA, 805 bp, Homo sapiens
  Payload ID: 6389
  Gene Symbol: FOXK2
  Gene Name: forkhead box K2
  ENST ID: ENST00000531030
  CDS Start-End: 290-805
acagctgcgctcagctcagagccagcttcgtgtgcagagcccagcagagatggcggagccacttggcatccaagcaccttgccctgtttgtgtccacctggttctgccgtgagaacccctgggttttaagccgttaggctggtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccct

SEQ ID NO: 135018 - DNA, 3462 bp, Homo sapiens
  Payload ID: 6389
  Gene Symbol: FOXK2
  Gene Name: forkhead box K2
  Uniprot ID: Q01167
  ENST ID: ENST00000473637
  CDS Start-End: 177-2021
cgcggccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggccgcggcggcgctctcgggcgcgggcacgccacccgcgggcggcggggccgggggcggcggggccgggggcggcgggtccccgccgggcggctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggcggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagt

SEQ ID NO: 135019 - DNA, 571 bp, Homo sapiens
  Payload ID: 6389
  Gene Symbol: FOXK2
  Gene Name: forkhead box K2
  ENST ID: ENST00000575578
  CDS Start-End: 1-388
caccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacatgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcatgggattcccgtgggaggacctgcctgaaaagagatgagagtttctaatacattgagagggaaaaatactctcgcctcttgtagatttcctgggtgtggcctggaagcggcc

SEQ ID NO: 135020 - DNA, 3450 bp, Homo sapiens
  Payload ID: 6389
  Gene Symbol: FOXK2
  Gene Name: forkhead box K2
  ENST ID: ENST00000622867
  CDS Start-End: 177-2009
cgcggccgcgcgtgctcccgcccctcgccgccgctcgctcgctcgccggccggcggcctccgctcggccccctccctcagctccggtgcgcggcggccgacgacccgcgcggcctgggcctcggcccgcgccaccggcgcccgcgcggagcggcccgggggccctcacgcaggcccatggcggcggcccggcgggctctcggggcgggcacgccgcgggcgcggggccgggggcggggggccgggggcggcgggtcccgccgggcgctgggccgtggcgcgcctggagggccgcgagttcgagtatctgatgaagaagcgctcggtgaccatcggccgcaactcgtcgcagggctcggtggacgtgagcatgggccactcgagcttcatctcccggcgccacctcgagatcttcacgcccccgggcggcggggccatggcggggccgctccggagctgccgcccgcgcagcccaggcccgacgccggcggcgacttctacctgcgctgcttgggcaagaacggggtattcgtggacggcgtgttccagaggcgcggggcgccgccgctgcagctgccgcgcgtgtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagt

SEQ ID NO: 135021 - DNA, 3655 bp, Homo sapiens
  Payload ID: 6390
  Gene Symbol: FOXL1
  Gene Name: forkhead box L1
  Uniprot ID: Q12952
  ENST ID: ENST00000320241
  CDS Start-End: 219-1256
agggctaagtcaacatataacagcaaacttacaacaattatttaacatttttaaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaaagaacatgtttcattctttgcataaatacttgactctaagcattgacctttgaaaacgcttgtattaacaatttttattaagaaagtgcactctatataacatcttcttgcattacgatagctcattagccaatacacatgcagctatgtaagccacaacagcagacgtcctatccttttgcttttgtttttaagggatcaaaatatttcaagggataccatgaggaagggtgtgaggggaaggggatatgccttggacaatgtcagagttttgatttccatgttttttcaagatccaggcttggtggtcgctatatttttcagaaacagataatgaaagactacatttaatttaaaaagttgggtgaaacaaccaaaagcagatgcagagagagagagggatgaatgcgggggaagaataaggggacgtgctggtgtccgctggaaggggcctctctgggccccagaggacctgaggtttgatggcaggaatctcccagacactcctggcccccgcaccccctgcagccgcccgctcttccctcccagccctgccaggcaggcctggaggctgatactaaatcaaaaccttaaagaggtgactggcagtctggggaggggagaagaggtctgcaacgaaaatctaattaagaacattgagatgttcacaaccaagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcagtgactggttcagtggattactggagggaaataaacaaacagtgtaataagaaagaggagactgggattatatctgggagtcgtgttagcatctcaggaggctctggcttctgaggggtaaacacacagatggaggggaaggagtggagaggatgccgggcccaggaagctgcctccatatcagaaagcacgatgagttaattctgccgtattgaatcggtttttaatctttcctttttcttttttgtgtttgtatgttatcttgggaggttttgttaatttgtgatggctatgttttgaagaagcaaataatttgatactgcagttttaaaagggtcgtattttaaagttactattccaaaaagtattgtacgaatgttacttttatgacacagaaaaaatgcagatgtatccactttgtgtgtttatacatgcataaagagaaattctatttaatcccaa

SEQ ID NO: 135022 - DNA, 592 bp, Homo sapiens
  Payload ID: 6390
  Gene Symbol: FOXL1
  Gene Name: forkhead box L1
  ENST ID: ENST00000593625
  CDS Start-End: 250-592
ggcgggagtttcggtagaggcagggatgtgcgtgctggacttcgggtgccgcgtggggagctccaggaggggctgtgggataggaagccatgaagaagggacagagcacggagcggccggggagagcggcagagccagaggcagaggcacggctggctccccgggagggcccttgcggcgcggggcgcagtgcctaggccgcccgggtctcctgcgttgcggggagcgcagcgcaggctctcgcttgccatgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaag

SEQ ID NO: 135023 - DNA, 2917 bp, Homo sapiens
  Payload ID: 6391
  Gene Symbol: FOXL2
  Gene Name: forkhead box L2
  Uniprot ID: P58012
  ENST ID: ENST00000330315
  CDS Start-End: 419-1549
atcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaa

SEQ ID NO: 135024 - DNA, 3475 bp, Homo sapiens
  Payload ID: 6392
  Gene Symbol: FOXM1
  Gene Name: forkhead box M1
  Uniprot ID: Q08050
  ENST ID: ENST00000342628
  CDS Start-End: 115-2520
ggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtaagttctttagtggcgatctgcgagattttggtacacccatcaccagcttgtttaattttatctttctttgtttatcagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaca

SEQ ID NO: 135025 - DNA, 3315 bp, Homo sapiens
  Payload ID: 6392
  Gene Symbol: FOXM1
  Gene Name: forkhead box M1
  Uniprot ID: Q08050
  ENST ID: ENST00000359843
  CDS Start-End: 70-2361
cggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggac

SEQ ID NO: 135026 - DNA, 3370 bp, Homo sapiens
  Payload ID: 6392
  Gene Symbol: FOXM1
  Gene Name: forkhead box M1
  Uniprot ID: Q08050
  ENST ID: ENST00000361953
  CDS Start-End: 169-2415
gggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaca

SEQ ID NO: 135027 - DNA, 618 bp, Homo sapiens
  Payload ID: 6392
  Gene Symbol: FOXM1
  Gene Name: forkhead box M1
  ENST ID: ENST00000535350
  CDS Start-End: 1-618
tgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagag

SEQ ID NO: 135028 - DNA, 693 bp, Homo sapiens
  Payload ID: 6392
  Gene Symbol: FOXM1
  Gene Name: forkhead box M1
  ENST ID: ENST00000538564
  CDS Start-End: 1-243
acagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggt

SEQ ID NO: 135029 - DNA, 3487 bp, Homo sapiens
  Payload ID: 6392
  Gene Symbol: FOXM1
  Gene Name: forkhead box M1
  ENST ID: ENST00000627656
  CDS Start-End: 284-2530
tttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatg

SEQ ID NO: 135030 - DNA, 3436 bp, Homo sapiens
  Payload ID: 6393
  Gene Symbol: FOXN1
  Gene Name: forkhead box N1
  Uniprot ID: O15353
  ENST ID: ENST00000226247
  CDS Start-End: 30-1976
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaacatctacccgggcaccaaactgagcccaattccgaagcagtgtttggaaaagcccttgccctcggaaacttgaacatgtcctttttccccagtcccgggtgcaggaagggccccctccaggtcaccacaatctcactcctcctccagaaagaaaagttcacatagtttaggtcctggcttaactctacttatgatggttcaacttacactttttcaactttaagatggtgcaaaagcaatacacattcagtatgttcctcgacttaggatgcggttatgtccgataaacccattgtaaattgaaaccaccgaaagtcaaaaaccactttcgacttacgatgtttcccactcacgatgggtttctccggatgtagccccatcataagttgaggagcacctgttagttacttccaactgtctcaggcaacctgggcattcaggagaaaagcctggcacagggtgacagggaagcacccatgcaaagcacccccgctttgactgcttggcagacctagggtgcccgggaagcacaagggatacccttggccctgcggggtgtggcccaggtgcctgccatgagcctgaccccatcgagggggaacctcagcccaccctgggcctgggggtgacaagaacttccacaggttggccccaggcttataggaggcataagcagatcccgcgatggcttgtcattgtcccctgtcctggaacaataaagcaagtgccttgtggtctc

SEQ ID NO: 135031 - DNA, 562 bp, Homo sapiens
  Payload ID: 6393
  Gene Symbol: FOXN1
  Gene Name: forkhead box N1
  ENST ID: ENST00000577936
  CDS Start-End: 211-562
acctttctcttctccccgttttggcgcagcccctccgggcaaggggaagctgatatcataattattggctcacctggcagctgcctcccctcacctgatgtcagcacagacacaggacggccgagctgacggactgacagacggacagagctcctggccccccagacccgggcccccacgccgacctgcttcactgagcaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagg

SEQ ID NO: 135032 - DNA, 2145 bp, Homo sapiens
  Payload ID: 6393
  Gene Symbol: FOXN1
  Gene Name: forkhead box N1
  Uniprot ID: O15353
  ENST ID: ENST00000579795
  CDS Start-End: 199-2145
gttttggcgcagcccctccgggcaaggggaagctgatatcataattattggctcacctggcagctgcctcccctcacctgatgtcagcacagacacaggacggccgagctgacggactgacagacggacagagctcctggccccccagacccgggcccccacgccgacctgcttcactgagcaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatga

SEQ ID NO: 135033 - DNA, 5408 bp, Homo sapiens
  Payload ID: 6394
  Gene Symbol: FOXN2
  Gene Name: forkhead box N2
  Uniprot ID: P32314
  ENST ID: ENST00000340553
  CDS Start-End: 262-1557
cgcgtcttcccggaggcgactgctggaagctgcagggaacagctgcggtgctctgccatattgtgtcttccccggccggtccctcgcctcccggccgagctgacgttggttgaagccatggataacagaacccacagatgcagagggctgactgtacaagtctgtcaaaaaaccaaactgctggttggctaataattggtcactgtatgacttatagtacaggtgatattacttctgattctagatgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaacatttttggtttttggtttttaaaatttttattaaacaattgctgttaggatcatgcctgatcagaaatacatgatgtgaagtcctaaaagcataatttttgtgataaatgtgtccaagatttgaaaatttttatataagaaaatccccagcctctgtcttaaacttgtgggacaaaaatcctttcttctgttaatatgtcagaatgtaagatttggcaactcgataaatttttttcattttcttttccaatctgtaactatagttactgaaccagctaaaaattttgctgatgtatttttcatatacttctctcctgacacgcaatccggtaacataagattgaaatttttttactttgtcttaatttgtttctaattttttttttgttgtcgtgtgagcaaagacaaacataaattgaaaaacatcctgatgtttagaaagtttcttttggttacgtaggtagagaatacaacaaagagttctaagacttagaaaagacaattttgtggtgtcatttcatccaagaacactcccaattcctattagaatggtagctttgaagtgtttttacttcagagatcctgcatagcatttattggggccttttattctttcccaaagtgctttgcaaacattaagttttagccactagctgcctttgttgagtataagttatccagtgagaggatatagccaattaagtgtgttatggagtacacccattttgacacacttgtaataagagaatctttcatttgcctgccatgtgtactgtattatgagaatcttataatcggaatggagtgaaatgaaacattttgagtactgatggcatgttatcatacataaagtaggtcatttaggaaaaaacttctgtccaagctttgtatgaattaaattcataagtataccaaattaaatcttaatagatttaatgcaattttacagacacaataccttcatgaatttcaaaattcatataaaatttgatcttatgcaatacacctttttgaggaggcagtgtaacaacctatagtgccattgatccatgagaaaaagattttctggtactactccaaaagtgctttgactaagtatcttaactatttgaacagtctgcttatatgagacagtttttcatagtatcatttgtataatttgattagattattcagaaacaataggatgctaaactaattcattgtatcttttttttacaatggtggaagcaactttctgaaagttcagtcttatgctacatcctaagtcatagacaatgaccttgttttcattattctgatagattgtatacatatgtacacatacatatacacatatgcacagtcaaggtcatgatgttgatttgctttcagctgtttctgtgattataaagcattttttaagagacaaattttaacttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttattttgttctgctgaaattctgtatcacaaatgtgctacctggtttttgtccattagataattactctttataaggaaaggaaagagaagcagagttagttccagctctaatagggatcttcaaagttattttgtcttgatgtatgtaacagtaattctttacatcttttgatttttctcttcctttttattcactcttcccacgaatttaaatgtttaagttatattcatcactagcaaggatgataaacacttgtgcactgaaagctaacagggagaggttacacaatattttacagtttcttaaacataatttaatgcatcaccttccacttgctaacataccaagtcagttattttcaagggaagaaccttttaaattatggtcctccatttactacttccactgagagtatgctctcattcctcaggtgttttgagaaacatgactaataaccacacaattaagtagagtcattccaagtcctatggcctggaaattgtattccctataatatacaaattttcctgtaataaagtcaacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggaaaaggtggatcacctccctttttccaccttcaagcctttcctgtcctcatagccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataacttt

SEQ ID NO: 135034 - DNA, 932 bp, Homo sapiens
  Payload ID: 6394
  Gene Symbol: FOXN2
  Gene Name: forkhead box N2
  ENST ID: ENST00000413569
  CDS Start-End: 193-932
gggaggaagcgagcgggagggggatgtggtgctgccggggccgccactgcagctgctgctgcctgctggttgccgcgtcttcccggaggcgactgctggaagctgcagggaacagctgcggtgctctgccatattgtgtcttccccggccggtccctcgcctcccggccgagctgacgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgctttt

SEQ ID NO: 135035 - DNA, 1414 bp, Homo sapiens
  Payload ID: 6394
  Gene Symbol: FOXN2
  Gene Name: forkhead box N2
  ENST ID: ENST00000616844
  CDS Start-End: 270-1292
gggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaaca

SEQ ID NO: 135036 - DNA, 2542 bp, Homo sapiens
  Payload ID: 6395
  Gene Symbol: FOXN3
  Gene Name: forkhead box N3
  Uniprot ID: O00409
  ENST ID: ENST00000261302
  CDS Start-End: 17-1489
aggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccat

SEQ ID NO: 135037 - DNA, 7832 bp, Homo sapiens
  Payload ID: 6395
  Gene Symbol: FOXN3
  Gene Name: forkhead box N3
  Uniprot ID: O00409
  ENST ID: ENST00000345097
  CDS Start-End: 118-1590
ccgggagacggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaactagaaagctacggaacctgccattagtattgtggtgtatttttaagattaaaggtacactgatggacaaaaaaaaaaagtaaaacatggcaaaaaataaaataactcctatactgccctcaaaatggagtttgcaattaatatcaggatttatctttgcaaaaatcagtgatttccacattcagccagtatagccagcagaaatttctgatccacaatgcatggattcctttgaagaaaaaaaagaaaaagagaaaaaaatcacaaaaacaaactttttttattcaaaagtaacaaagttcttgtaaggtaaataatgtatttagcatgaagcatgaattattttcatataaatatagaaaatagagaaaaggctatgcctgtaatttttaagcccttaggcttagagtttcttttggttttcttcttttttctttccttttctttgctttctttttttcctttttgtttttgtttttgttttttgtttttgtttttttttcgggttattttgttttggttttttgaagcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcagtgaataattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtacaaagagaaatctctaaaagaatatgatcttccatccaagtggagggaaactttaaaacaaaaacacccagtactgtggctcaggatatgatgcgtgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattcagggtgtaggtgggaataaagtatcttcgcagtgctctgttccctccgtctccccagacatctgacaccctaaaagccatccacagctatggaacctgagcgacaccttgatttgtgttgtcacctgaccaagcctaaagacctccagctcagtcccccaccttcatcccaccccacagatgataaaattcagacctctctcctgaaaggcagaggttcaacattcaggactgtttctggccgaggacttcttccaattaaaacccccaccgtgggctgtctcccctcatttcatttttctaaaggggcagaggcctcttttagaaaataataaaatgcaatgtgtgtgatttacttttctgatctctttgagaaatagagaaatataaaagtgtgttcttaactccagaaccactctttttgcataaatacctcatcgggcagctttctaagtgtgattttcctgagtctcccttcgttggatctgccggaagacttgtcggggaacctttagtgagggtacttcttcctatttttcttctgtttttggaggcatacacattatgcataaccaaaacaatggctcaattgtgtttaactttgtattttgattgttgagaacaaaaacaaaaagtatcaatgtgtatgtggctgtttgtagtgaatttattggagaatgaggttgtccgtgtccttaacaagccaaggggcaggaggcaccctctcttatcccctcctccaagagcagtagagaatttaagcacaagcctatttgtgaaagaatattttgcttaagtgtcattcactttagtcttggaattccttcccaaacgtcaggtgttcttttagcttccaaactagcatatgtatccattagtctgacagatcgcctgaacaccattaagaggtgtggcgtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacacca

SEQ ID NO: 135038 - DNA, 467 bp, Homo sapiens
  Payload ID: 6395
  Gene Symbol: FOXN3
  Gene Name: forkhead box N3
  ENST ID: ENST00000556916
  CDS Start-End: 1-335
tctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagaaaaatgaaaaccttcatctccattgagaaacaaggctgaacactgtaaggagggttacagaatttaaagcagatgtgacctctactatccaagaatgtttgtttatctatttatttaataaagagtgtgtggcgcctgt

SEQ ID NO: 135039 - DNA, 513 bp, Homo sapiens
  Payload ID: 6395
  Gene Symbol: FOXN3
  Gene Name: forkhead box N3
  ENST ID: ENST00000557572
  CDS Start-End: 1-240
cggccgctgccaatcactcccattggggtgacagcggccatgagacaaagtgtgtataccatgattcatctttgtgactctagcagccaaacatacattgtgccagaactttcagctacaagcattttcctccaccttcctcttttgggagaaagacgcaacagttctgtggagagcatcataattcagaggacatgcaggaacctcagccaacaacacaaacttcaggaccaagcatgatgttaacattttcaatagcagggcttgtagggggcaggaagaagaggagacaagaagtcaagactcctaatctcagctccgcatgaatggaaaaacctctttatgcttctgttattttcttccataaaagtagattggggaaagagtatagttgttcttcaaaaagtaaatataaaactaccatataacctagcaattccactcctaggtatatacacaaaagaattgaaaactgatacttaaacaaacatatatacatgcatgttcatagca

SEQ ID NO: 135040 - DNA, 555 bp, Homo sapiens
  Payload ID: 6395
  Gene Symbol: FOXN3
  Gene Name: forkhead box N3
  ENST ID: ENST00000553840
  CDS Start-End: 1-555
ttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaact

SEQ ID NO: 135041 - DNA, 450 bp, Homo sapiens
  Payload ID: 6395
  Gene Symbol: FOXN3
  Gene Name: forkhead box N3
  ENST ID: ENST00000554005
  CDS Start-End: 1-276
tttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagagacggggtttcaccatcttggccaggctggtcttgaactcctgacctcgtgatccacctgcctcggcttcccaagtgctgggattacaggcgtgagccaccgagcccggcctggtgctgaaccaaattacatttccaccaacaagcacatcaggtccacccatctggccgggcagtaccttcttcaagagaaatggagcccttctccaag

SEQ ID NO: 135042 - DNA, 851 bp, Homo sapiens
  Payload ID: 6395
  Gene Symbol: FOXN3
  Gene Name: forkhead box N3
  ENST ID: ENST00000555855
  CDS Start-End: 228-851
agctcggccgggagacggcgcgacccggcggcggggccacccgcgagtccagcgtcgccgcagccccccaatgcggccgcgagaagcagcgggggggcaggcgatcgaagcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttat

SEQ ID NO: 135043 - DNA, 398 bp, Homo sapiens
  Payload ID: 6395
  Gene Symbol: FOXN3
  Gene Name: forkhead box N3
  ENST ID: ENST00000557718
  CDS Start-End: 1-231
gcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagggaaggatgactaagagtttagtgctggaagagcagaagaggaaagctggaagatcagaaatgaaattggagctgttgatgcgtgtgtctctatgcacatcaggtccacccatctggccgggcagtaccttcttcaagagaaatggagcccttctccaagttcctccaggagtgatc

SEQ ID NO: 135044 - DNA, 337 bp, Homo sapiens
  Payload ID: 6395
  Gene Symbol: FOXN3
  Gene Name: forkhead box N3
  ENST ID: ENST00000553904
  CDS Start-End: 174-337
gtagcttgcaggtttctgatatcgcatcagtggacaggcggcatgcactatattaacagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccat

SEQ ID NO: 135045 - DNA, 2692 bp, Homo sapiens
  Payload ID: 6395
  Gene Symbol: FOXN3
  Gene Name: forkhead box N3
  Uniprot ID: O00409
  ENST ID: ENST00000557258
  CDS Start-End: 257-1663
gcgggaggacgcgcggcgcgcccggcggacgccgcaggtcccatgccgcgccgcgacccccgcgcccctgccgcccgcgcccgcggccgccccccgccgcccgccgccccgggctcgccgcgccgcgcccgcgcgtccttagcggggccaccgagcgatgcccgccgggcgcccgcgaaagtttgtcggctcctgctgaagggcagcggcgcccccgcacccccgtgccccgctccggccaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtgaaaaaaaaaaaaaaa

SEQ ID NO: 135046 - DNA, 1595 bp, Homo sapiens
  Payload ID: 6395
  Gene Symbol: FOXN3
  Gene Name: forkhead box N3
  Uniprot ID: O00409
  ENST ID: ENST00000555353
  CDS Start-End: 137-1543
gcgatctgctgcagctcggccgggagacggcgcgacccggcggcggggccacccgcgagtccagcgtcgccgcagccccccaatgcggccgcgagaagcagcgggggggcaggcgatcgaaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtc

SEQ ID NO: 135047 - DNA, 505 bp, Homo sapiens
  Payload ID: 6395
  Gene Symbol: FOXN3
  Gene Name: forkhead box N3
  ENST ID: ENST00000555034
  CDS Start-End: 226-505
ggcattccccttctgcacgatggcaaaatctgggcaaagttgaaagttgcaagattccagtcaaacaattgtccttgcttgggtaaatatcctcaaatgaaaaaaaatcagcctctagaagaccagcattctcgtgattatggaggcccctctgtcttttctgtgacgggagcaatgctgacctcggtttcctggacccattccgactcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgaca

SEQ ID NO: 135048 - DNA, 366 bp, Homo sapiens
  Payload ID: 6395
  Gene Symbol: FOXN3
  Gene Name: forkhead box N3
  ENST ID: ENST00000553353
  CDS Start-End: 1-366
agtcatgtgagcgctgactctaatcgtggctatagtagagggggaagaaaagtcccgaatctccaagaatcaaggtacagggagcctggcacagagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttgt

SEQ ID NO: 135049 - DNA, 2421 bp, Homo sapiens
  Payload ID: 6395
  Gene Symbol: FOXN3
  Gene Name: forkhead box N3
  Uniprot ID: O00409
  ENST ID: ENST00000615335
  CDS Start-End: 1-1407
atgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaattaaaaacaagtcactgatttgttttgaacttacgaccatttggtttcagcatgtcaggagatttctaatgatttgtggcaatatcagcaattttttttcttttttcttgtttttggtttggttttctttcttttcttttccttttattttgttttaatttgccccctcttctttgttttggacccttaagaattttatttttaaaggagattgaagccatagaactcatattgacactcagctgttttacaaaagcttttcattatctgaagacaaaaccgaaaaagccaaaattaccattgcttcctccagcttgtcagaaacctgtggctgaatccgcagggatgtcaacgtcaatatcacaggaacacacattcggcacctagaaggcacgtgggcaaagtaatcatcgttcaggcccaacccttaggtttaaaaagtcaggttgtccatcccattgggttcactgagtgaaggcacataaagcaattgaggaggaggaggaacccctcgtccccctaggagcagacccaagcttgtggcaccaggcatctgatggtgccaggaaagccactggaattgtcacacggcgagcacagagggccggccaccagtcctcgatgcttctgaaccctgaagcccgatgacatcttacgaggtggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacacgaaggagagagagagaaaactgatggggaaaacaagctgtgtcttcttaactgcccaagtgaaaagcaaccaagtccaggaaattacaatagctgttaaggaaaggaaataatggtacagatctttttctgtctatcaaaactatttgatccaagtg

SEQ ID NO: 135050 - DNA, 3350 bp, Homo sapiens
  Payload ID: 6396
  Gene Symbol: FOXN4
  Gene Name: forkhead box N4
  Uniprot ID: Q96NZ1
  ENST ID: ENST00000299162
  CDS Start-End: 106-1659
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacaggcttctagccaccaccagcgatgatgaccttcccggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagcatgagccagttccccgtggggggccagccctcatctggcctgcaggacccgccgcatctgtactcacctgccacccaaccacagttcccgctccccccgggtgcccagcagtgccctcctgtgggcctctatggccccccatttggggtgcggcccccctacccccagccccacgtggctgtgcattcatctcaagaactgcaccccaaacactaccccaagcccatctactcgtacagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatgg

SEQ ID NO: 135051 - DNA, 2958 bp, Homo sapiens
  Payload ID: 6396
  Gene Symbol: FOXN4
  Gene Name: forkhead box N4
  Uniprot ID: Q96NZ1
  ENST ID: ENST00000355216
  CDS Start-End: 253-1266
aaattgcggaacgcgaggggcgagcgcgagggagcccccctccggaacccctgcccacccccggagcgccggcagcggcggccccgcgaggatcggctccaggagatgatagaaagtgacacctcatccataatgtcaggaattattcgaaactcagggcaaaatcaccacccctctccacaggaatacagggtcaagcagggcaggcttcctggcagaggcggcattgggctgtcagcctgagaccctttcatgcctggcctgccctgtcctgccctgccctgccctgccccacctcctgcccccagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctttgagctgtcagcctcacctgccctggaaccccggcacccggcttgggcagagaactgactagaacagggtgttcccagaaggcaggtccctcattgtccccgaagcctctcctggacctgtggcgaagttgccggctggacagggaagcggttcccctcagcagcccctctccttctcgtgcctccccctggagcttccggagcagtttctgggggctcttccaagtcagaagaatggaggaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggc

SEQ ID NO: 135052 - DNA, 1219 bp, Homo sapiens
  Payload ID: 6396
  Gene Symbol: FOXN4
  Gene Name: forkhead box N4
  ENST ID: ENST00000423960
  CDS Start-End: 1-657
ggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagccagatgagccagttccccgtggggggccagccctcatctggcctgcaggacccgccgcatctgtactcacctgccacccaaccacagttcccgctccccccgggtgcccagcagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtac

SEQ ID NO: 135053 - DNA, 1593 bp, Homo sapiens
  Payload ID: 6396
  Gene Symbol: FOXN4
  Gene Name: forkhead box N4
  ENST ID: ENST00000468516
  CDS Start-End: 1-253
gaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggacaagcaacccagcatcccccgaccccttgacactcctccgaggcctgagccgcaatgcctgcccgtgttgagtgagacttctccatcctggatcctggctgcgtgacctcagtgacctgcaccccattttgggacaccttggtgcattaaggaaacaccctggggtgaaagcccttgaattcatcctcatgggaaatggctgagtggatcaaacctcagccgcagcctccgggggacaggcccagggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgattcacatctcttcttgcatgtacctaagaggggcggtgccattgtttgggggcttggggggctttcaaaggggaaaatgcgatgggagagggaggaactggaggggggtgcttttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggc

SEQ ID NO: 135054 - DNA, 5735 bp, Homo sapiens
  Payload ID: 6397
  Gene Symbol: FOXO1
  Gene Name: forkhead box O1
  Uniprot ID: Q12778
  ENST ID: ENST00000379561
  CDS Start-End: 386-2353
gcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaagtcttgtcagcca

SEQ ID NO: 135055 - DNA, 7308 bp, Homo sapiens
  Payload ID: 6398
  Gene Symbol: FOXO3
  Gene Name: forkhead box O3
  Uniprot ID: O43524
  ENST ID: ENST00000343882
  CDS Start-End: 305-2326
gggaggaggaggaatgtggaaggtggcggcgcgcgagctgacaggcggttcctcgggcgggctgcggcgacggcccgagcgcttctccttcgccgaggttgcgcgccccctcctcgccgtgccccgggcccgcgcgggatcgtgcgtcgtcccgccgcgtccctgaagggaaggaagcgaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctatctta

SEQ ID NO: 135056 - DNA, 7341 bp, Homo sapiens
  Payload ID: 6398
  Gene Symbol: FOXO3
  Gene Name: forkhead box O3
  Uniprot ID: O43524
  ENST ID: ENST00000406360
  CDS Start-End: 344-2365
gcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactct

SEQ ID NO: 135057 - DNA, 2553 bp, Homo sapiens
  Payload ID: 6398
  Gene Symbol: FOXO3
  Gene Name: forkhead box O3
  Uniprot ID: O43524
  ENST ID: ENST00000540898
  CDS Start-End: 233-1594
gagtggacagtctccacaaggtaaacatggtttggaagggctgaagcggacgtagggtacaaaatttaagaaattaccagttacttctgactggcacggcacctctgaaatacttttttaaagtttgaaatcctttcctggaaggggccgccctggaaccttttggcttaaagtatatgatgctcggaaaacaaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagg

SEQ ID NO: 135058 - DNA, 1353 bp, Homo sapiens
  Payload ID: 6399
  Gene Symbol: FOXO4
  Gene Name: forkhead box O4
  Uniprot ID: P98177
  ENST ID: ENST00000341558
  CDS Start-End: 1-1353
atggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctga

SEQ ID NO: 135059 - DNA, 3301 bp, Homo sapiens
  Payload ID: 6399
  Gene Symbol: FOXO4
  Gene Name: forkhead box O4
  Uniprot ID: P98177
  ENST ID: ENST00000374259
  CDS Start-End: 333-1850
caatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagct

SEQ ID NO: 135060 - DNA, 2398 bp, Homo sapiens
  Payload ID: 6400
  Gene Symbol: FOXO6
  Gene Name: forkhead box O6
  ENST ID: ENST00000372591
  CDS Start-End: 10-1689
ggcgggaccatggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccggggccccgccccccaaccagagctgggtgccgggctgagggccgcctcccgcctccgggcgccccgtcccgtccccagggggcctctgtcttcccatcctgattcccgggtccctgcccccgactctagctccccaggaggcggccccagcccagctagggacccctctcggaggccggccgccggggaaggggagggaggggccggggcaccccactgctcctgcccacactcctgagatccacccccttctcctgggcaggaagcctgggagaggaggctgaattccaggctggctgggagtagggaggagcggggtgggccgcctggtgtggacggtggtcggggaagccaactaggagatgggccagggagcgtttacaaatcttcagtttcatttgcggaggcctagccgtgaccccgcgcccaccccaaacacggatctgattcccacttgacacactttcccactggtcttagtctcacccacccgaagccagcaaccctctgcggaaaactcacacctacctatatccatccaccctgagcagccctccacccccaaatcgccctccgacgaccgccacccccacagttcagtctccccctcccatccctgccggccctcgcttctcccctcccccgtcggagtcagtccctctcttcaaccgcccccaccccctagtactggtctcagcttctgcagcgggcctcagccccgtccacccccaaccccgacgcccctttctccgcgccagttctggcccttctcccatatttataagtgtccggccgggacgggcggtgggcgcggcgtccccggcgcgtatcgtaggcagtgtaccgtggccgtgccgtcagagtgtgcgtgtgcgtgtgtgccgtgtcgaggctgtgtagagtgcattgtacagcatattttcatgaataaaattgttttaaatatt

SEQ ID NO: 135061 - DNA, 1476 bp, Homo sapiens
  Payload ID: 6400
  Gene Symbol: FOXO6
  Gene Name: forkhead box O6
  Uniprot ID: A8MYZ6
  ENST ID: ENST00000615371
  CDS Start-End: 1-1476
atggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccggggccccgccccccaaccagagctgggtgccgggc

SEQ ID NO: 135062 - DNA, 1680 bp, Homo sapiens
  Payload ID: 6400
  Gene Symbol: FOXO6
  Gene Name: Forkhead box O6
  ENST ID: ENST00000630406
  CDS Start-End: 1-1680
atggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgccggggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgtcgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccaccgccgccgggcctggccggggccccgccccccaaccagagctgggtgccgggctgagggccgcctcccgcctccgggcgccccgtcccgtccccagggggcctctgtcttcccatcctgattcccgggtccctgcccccgactctagctccccaggaggcggccccagcccagctagggacccctctcggaggccggccgccggggaaggggagggaggggccggggcaccccactgctcctgcccacactcctga

SEQ ID NO: 135063 - DNA, 2590 bp, Homo sapiens
  Payload ID: 6400
  Gene Symbol: FOXO6
  Gene Name: Forkhead box O6
  ENST ID: ENST00000627423
  CDS Start-End: 1-1680
atggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgccgggacgcccgcctacttcggcggctgcaagggcggcgcctacggcgggggcgggggcttcgggccgccggcgatgggcgctctgcgccgtctgcccatgcagaccatccaggagaacaagcaggccagcttcgtgccggccgcggcgcccttccgccctggggcgctgcccgcgctgctgccgccgccgccgcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgtcgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccaccgccgccgggcctggccggggccccgccccccaaccagagctgggtgccgggctgagggccgcctcccgcctccgggcgccccgtcccgtccccagggggcctctgtcttcccatcctgattcccgggtccctgcccccgactctagctccccaggaggcggccccagcccagctagggacccctctcggaggccggccgccggggaaggggagggaggggccggggcaccccactgctcctgcccacactcctgagatccacccccttctcctgggcaggaagcctgggagaggaggctgaattccaggctggctgggagtagggaggagcggggtgggccgcctggtgtggacggtggtcggggaagccaactaggagatgggccagggagcgtttacaaatcttcagtttcatttgcggaggcctagccgtgaccccgcgcccaccccaaacacggatctgattcccacttgacacactttcccactggtcttagtctcacccacccgaagccagcaaccctctgcggaaaactcacacctacctatatccatccaccctgagcagccctccacccccaaatcgccctccgacgaccgccacccccacagttcagtctccccctcccatccctgccggccctcgcttctcccctcccccgtcggagtcagtccctctcttcaaccgcccccaccccctagtactggtctcagcttctccagcgggcctcagccccgtccacccccaaccccgacgcccctttctccgcgccagttctggcccttctcccatatttataagtgtccggccgggacgggcggtgggcgcggcgtccccggcgcgtatcgtaggcagtgtaccgtggccgtgccgtcagagtgtgcgtgtgcgtgtgtgccgtgtcgaggctgtgtagagtgcattgtacagcatattttcatgaataaaattgttttaaatattt

SEQ ID NO: 135064 - DNA, 843 bp, Homo sapiens
  Payload ID: 6401
  Gene Symbol: FOXP1
  Gene Name: forkhead box P1
  Uniprot ID: Q9H334
  ENST ID: ENST00000318779
  CDS Start-End: 477-821
gctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaa

SEQ ID NO: 135065 - DNA, 7114 bp, Homo sapiens
  Payload ID: 6401
  Gene Symbol: FOXP1
  Gene Name: forkhead box P1
  Uniprot ID: Q9H334
  ENST ID: ENST00000318789
  CDS Start-End: 527-2560
ggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaa

SEQ ID NO: 135066 - DNA, 5685 bp, Homo sapiens
  Payload ID: 6401
  Gene Symbol: FOXP1
  Gene Name: forkhead box P1
  ENST ID: ENST00000327590
  CDS Start-End: 3426-5126
tgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggacaggatattgctgtgttgcccaggctggagcgccgtggcacgattatagctcactgtaatttcgaactcctgggctcaagtgatcctcccacctcagcctctgttgtagctgggactacaggtatgtgccaccatgcctggctaatgatttttaatttttaatttaatttaatttaatttttttgtagaggtggggtctcactaggtttcccaggctgatcttgaactcctggccccaagtgatcctcccaccttggctgcccaaagtgctaggattacaagtgtgagccactcactctttgcattattttttgatagttgtattagatttgcattttcaggacatttagccatttatatgatactctcccccttttaactctaaccctattgtactttttagtaatacaggtatgttcagtgctcagtaccagttcttcagtccttatgtcaatgtctgtagtcattttgtctaaacttcatttctgttagattttttggaaaaggctcatgggtactgtattccctgaattcttgaattttcgtaacagtttgctgtgttctttatacttaaaccacaatctttactgaattaaaaatgttgcctcacattttttctttgcatatcttaaatatgttactcctttttcttctggcataataagtcttaagtccagtaattttattagattatatcttagtgtcggtcatttggagcaaatatgcttcagtgtccagggtccttttgcaatatgtagtttcagaatatttttttaatttcaggaatgtttctttgaattatagttttaggtatttggacaattttcttcctttgctttcctctccagggattcctacttttttttctttcttcttttagttttgagctttgtcacccaggctggagtacagtagcatgatcttggctcgctgcaacctgtgcctcccaggttcaaacgattctcatgcctcagcctcctgagtagctgggactacaggcatgtgccaccacgcctggctaatttttgtctttttagtagagacagaatttcgccatgttgaccaggctggtcttgaactcctgggctcaagcagtcctcccaccttggcctcacaaagtggtgggataacaggcgtgagccaccacacctgacccagggattcctattttctatatgttggatctcctttacctgtcttcagtattcgatactttcccttaaatccttctctctctcttaatttctgtttgattttgtttttcattttaaccttctagttttttttaaagcgttatttgttgtatctatttgctatctgtccctctagtgtattttcttatttctagaatgatttttctttttttcaagtttattctttcttcccccatttctcagccagtcgaattcttatttatgtaattcttttttgtttattttcttttgttttgtttttttaagatagggtctcactctgtcattcaggctgaagtgcagtggtgccatttcagctcactgcaacctgtgcccccaggctcaagcgatcctcccacctcagcctcctaaatagctgggatcacaggcacgcaccaccacacccagctatttctttgtatttttttgtggggacagcgtctcgccatcttgccctggctggcttcaaactcgtgagtgcaagtgatcctcccacctcggcctcccaaagtgctgggattacaggtgtgagccactgtacgtggcttgatttatgtaattctttcaggccgtatatcttattcttaatgtcttttagctcattttgaagtaataggttacagacaagtaatgacatgtctgataaatgctttcattttgtgtaagatgttattctgttcctttttttttatcactttgtatagaattttacctcaaaatttttatattgctcatttttacgtgaaagtgatttttctgaacttttagcagggtggctgtattaagagagatcttctaattccttagagctctctctcttttgggttactttctactacttggctactggcatgctttctaaaatatctttactgtattcttctctactttggggaggcctttctcttatctttcctcttggttttctctgtcctttttgattttgattctgttgccaggagtttttcctcagtgtggagtcctatgctagaatggagacctcacagcccagttttgagagttcataagcactagactcctcccagctctgcagacttttcttaatacgggccctttgctctgaccctttgttggaacgggaaataccccacagccctaagttcagctgctattttaaacttggctcaccatactgtccatttagtacttattggcaatactggggttctttttctcagttctttccgttgctgcattgccgccctctgcttcttcccacctaggtgctactattctgtaggacttgaggctagtcttagcttttccacatctgttgtattacagtgttcaaagtgacactggtcacttgattttattttttacttttttgagatagagtcttgccctgttgcccaggctggagtgcagtggcatgatctcagcacactgcaacctccacctcccaggttcaagtgattcccctgcctcagcctcccgagtagctgtgattaattacaggcacgtgccaccatgcctggccaatttttatatttttagtcaagacagagtttcactattttggccaggctagtctcaaactcctgacctcaagtgatccacccacctcagcctcctaaagtgctggtgtgtccggaattggtgggttcttggtctcactgacttcaagaatgaagccgcggaccctcgctgtgagtgttacagttcttcaaggcggcatgtccggagtttcttctttctgatgttcggatgtgtttggagtttcttccttctggtgggttcgtggtctcgctggctcaggcgtgaagctgcagaccttcgcggtgagcgttacagctcttaaggcggcgcgtctggagttgttcattcctcccggtgggttcgtagtctcgctggcttcaggagtgaagctgcgatactgttttggaacatgtatgctgcgaattcttccagcgggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggggtgccattcgcaccaacctctcactgcataagtgctttatcagagtagaggatgagtttgggtccttttggacagttgatgatgaagagtttaaacgtggccgccatattcaacgaggccgtcctcgcaaatactgccccgatgaaaactttgacgagcttgtcgcacataacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaa

SEQ ID NO: 135067 - DNA, 1996 bp, Homo sapiens
  Payload ID: 6401
  Gene Symbol: FOXP1
  Gene Name: forkhead box P1
  Uniprot ID: Q9H334
  ENST ID: ENST00000484350
  CDS Start-End: 155-1960
agtctagagacttagaagcatttattaacagtgaggctgctgaaggtttttaataacaaaattacaaatactctatctaattggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattgg

SEQ ID NO: 135068 - DNA, 795 bp, Homo sapiens
  Payload ID: 6401
  Gene Symbol: FOXP1
  Gene Name: forkhead box P1
  ENST ID: ENST00000485326
  CDS Start-End: 122-795
gtgcagtccgcctgcacgccgaggccgccggaccccacgcccggcccgcgcgggcgccccgagcccggctccgcgcgcctggcggctacatggagagtgtcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaa

SEQ ID NO: 135069 - DNA, 2400 bp, Homo sapiens
  Payload ID: 6401
  Gene Symbol: FOXP1
  Gene Name: forkhead box P1
  Uniprot ID: Q9H334
  ENST ID: ENST00000498215
  CDS Start-End: 324-2357
agacaataagaaacaaacggtacaactccacaaaaggcttcccggaaaataagtgtcaaataaatcctacggaactctcgcttctgccactgagctctgtatatgcaaacctgtttttatgccatcgcttccccaggctgagctgcgtttgtttggaaatgtaagccactgccttttctttttttcttttttccttttttttttttcccccctcacttcatctgagggctctggattaattccttgagacatatctttgcatacatatctcatgagttatgtttcctggagccttttactaggaacattaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 135070 - DNA, 1778 bp, Homo sapiens
  Payload ID: 6401
  Gene Symbol: FOXP1
  Gene Name: forkhead box P1
  ENST ID: ENST00000497355
  CDS Start-End: 1-1722
gcttcgcagaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtggattaaaatctcccaagaggaatgacaaacaaccagctcttcagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaa

SEQ ID NO: 135071 - DNA, 2703 bp, Homo sapiens
  Payload ID: 6401
  Gene Symbol: FOXP1
  Gene Name: forkhead box P1
  Uniprot ID: Q9H334
  ENST ID: ENST00000493089
  CDS Start-End: 630-2660
atttattgtgtggcggttgcacgctgtactcgcggcggcccggccctcgcccgggagtgcgtgtgtgcgcgcgtgtgtgcgcgagtgagtgtgtgcgcggggtgcgcgcgcgggcgggagtgggcgcgcgcggggaaaggcccgaaaacaccttagtttgcaccgagagaccatttgcagcggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaagg

SEQ ID NO: 135072 - DNA, 530 bp, Homo sapiens
  Payload ID: 6401
  Gene Symbol: FOXP1
  Gene Name: forkhead box P1
  ENST ID: ENST00000497553
  CDS Start-End: 162-530
gcttattgagagtagcttttgttgttgctattgttgtataaataagaaaggaatttaaagaattatttcttagcaaacgtgtggcagatgctttcttcggcagctgtcgttctagaggggaagtcgcctggttcagcgacgaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggtatg

SEQ ID NO: 135073 - DNA, 1842 bp, Homo sapiens
  Payload ID: 6401
  Gene Symbol: FOXP1
  Gene Name: forkhead box P1
  ENST ID: ENST00000468577
  CDS Start-End: 1-1842
atgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtga

SEQ ID NO: 135074 - DNA, 4967 bp, Homo sapiens
  Payload ID: 6401
  Gene Symbol: FOXP1
  Gene Name: forkhead box P1
  Uniprot ID: Q9H334
  ENST ID: ENST00000475937
  CDS Start-End: 432-2465
atcacagcttggtgctggggctcagcatggccaggtggctaaccagggcttggtgtcaactacatttgggatgatgacacttggaggacacagagccactgtgcagcaggagtcgccactgctaacagccagagtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaa

SEQ ID NO: 135075 - DNA, 2250 bp, Homo sapiens
  Payload ID: 6401
  Gene Symbol: FOXP1
  Gene Name: forkhead box P1
  ENST ID: ENST00000491238
  CDS Start-End: 155-2194
tgcaactttgaaaattacctgcaagctccaactgatctttcaactttgaaagtgaagaattacttgaggaattcttgtggtttctttgtcatttagtgagagcccagccagctactgtggaggcaaacctccctgaggttgcctacaaagggcaatgttccagtgtgttttctcttcgagtgtgcttcagccgcacagtacttcctgtttattcaaacatcttttttaccactcggcaacccccgcttcgcagaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaa

SEQ ID NO: 135076 - DNA, 429 bp, Homo sapiens
  Payload ID: 6401
  Gene Symbol: FOXP1
  Gene Name: forkhead box P1
  Uniprot ID: Q9H334
  ENST ID: ENST00000622151
  CDS Start-End: 63-407
agctgaagtgcagagagtgaatcatcagcattttctcctgaagacaggacagtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacagtggcatctcataaaccatcagccctctaggagtcccagcagttggcttaagagactaatttcaagcccttgggagttggaagtcctgcaggtccccttgtggggagcagttgctgagacgaagatgagtggacctgtgtgtcagcctaacccttccccattttgaataaaattattctttggagaaa

SEQ ID NO: 135077 - DNA, 577 bp, Homo sapiens
  Payload ID: 6401
  Gene Symbol: FOXP1
  Gene Name: forkhead box P1
  ENST ID: ENST00000610810
  CDS Start-End: 225-577
agtccttcctcacactgccgccagcctgggagccctgagagccagcaggcttccaagcgcctgtagtttctcccttacaaactctcaactttcttccgttgtgtgaaaattgcctctcccgccccaaagctttgcctcctcaccatgaacggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagca

SEQ ID NO: 135078 - DNA, 6384 bp, Homo sapiens
  Payload ID: 6401
  Gene Symbol: FOXP1
  Gene Name: forkhead box P1
  ENST ID: ENST00000614176
  CDS Start-End: 119-1852
cagtccgcctgcacgccgaggccgccggaccccacgcccggcccgcgcgggcgccccgagcccggctccgcgcgcctggcggctacatggagagtgtcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggt

SEQ ID NO: 135079 - DNA, 7140 bp, Homo sapiens
  Payload ID: 6401
  Gene Symbol: FOXP1
  Gene Name: forkhead box P1
  ENST ID: ENST00000615603
  CDS Start-End: 527-2608
ggggggtgggcgccagcgccccggcgaacggcaaagagggagccgctcccgctcggggggccgctggagtgcccagcgggaacccgaaagtttgtaagaggaagagagcgcgcggcgagcgagcgagcgggccgggggcagcggcagcggcgccggggaccatggtgctgccggcgcctcctccgcgggcgtgaaggcggcgctcctactccctccccggactccgcggtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcaggggtaagacgtgaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagggtgccattcgcaccaacctctcactgcataagtgctttatcagagtagaggatgagtttgggtccttttggacagttgatgatgaagagtttaaacgtggccgccatattcaacgaggccgtcctcgcaaatactgccccgatgaaaactttgacgagcttgtcgcacataacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggt

SEQ ID NO: 135080 - DNA, 713 bp, Homo sapiens
  Payload ID: 6401
  Gene Symbol: FOXP1
  Gene Name: forkhead box P1
  ENST ID: ENST00000472382
  CDS Start-End: 1-612
gttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaaggcagagcttccacacacagaggtaaagaaaccgtaaaagtagtatgtgacagtaaatgccatttctctcaggagaaagcaaattctgtattgtgttttttaataaaaatggctcagtgaaaaaaca

SEQ ID NO: 135081 - DNA, 2638 bp, Homo sapiens
  Payload ID: 6402
  Gene Symbol: FOXP2
  Gene Name: forkhead box P2
  Uniprot ID: O15409
  ENST ID: ENST00000350908
  CDS Start-End: 317-2464
ctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 135082 - DNA, 1412 bp, Homo sapiens
  Payload ID: 6402
  Gene Symbol: FOXP2
  Gene Name: forkhead box P2
  Uniprot ID: O15409
  ENST ID: ENST00000360232
  CDS Start-End: 13-1311
aggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgtaagtgcatattgctttataaacagtaaatagctctaccaatgtaacagactaagaaaatgaacaatttagtgacagttagaaaacaatgagtgtgatgaaaaatacggcaataaaatgaaagtaaaatgtaa

SEQ ID NO: 135083 - DNA, 2187 bp, Homo sapiens
  Payload ID: 6402
  Gene Symbol: FOXP2
  Gene Name: forkhead box P2
  Uniprot ID: O15409
  ENST ID: ENST00000378237
  CDS Start-End: 53-1150
gaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagtaggttttttacttttttttggtggggggcgggggctggattatatgggcattttaggcacattgtaaataaacaaaagatgaaggaggaatgtaaaagtccattataagtcatacttcaagatttttgtgggttccaacaagtggattagtaagatcaggcttcatcttttcattaagatattttacaaatcatttagtaaagatttttgaatgaatgaaaaatattagcctacaataatatgtcattaatcactggagacatttataacagaactatttataaaatagaattctcttaagttttaagtttctaattaatattatgtgagtcatcctaatatatatatatatatatatatatatatatatatatatatatatatatatttcagtaaacatattttgaaagttcgttttttaattacaggctttatatattttttaaaatagtagtatttagtatatacatgtaactacaagaattaaaagtgaaagtttatactggctaaaattaaaaaaactacatttcatttacattgttactttttgcccttagaaacatcaagaaacacacatggctatatgtttgtataacagattacatggcttctctagcttaaaaccaaaactttgtgtattcttaatttttaatagaaaattttatttttaaaaaaatcataaggggttctttttcaagtgaaaatcttcatctttcatgaaatgttttccttacacaattctggtgtacaagagatctaaacagagagctacagataggcttatggagatgagtaacttcacaggctgagactcttatgttgtcatggtgcagctaacagggtgagtgaactgtttcatgcttcatcaacaattaagttaattagctcatttgaaattgcactgctttgttgccaggatgttggcagaaacatcaaaaagatgtgtttacaaatggaagactgactacagggtatagagcaaaagcaccttaacaaccaggcacaagtacttggcatcacaataactttataaatgaat

SEQ ID NO: 135084 - DNA, 1472 bp, Homo sapiens
  Payload ID: 6402
  Gene Symbol: FOXP2
  Gene Name: forkhead box P2
  ENST ID: ENST00000390668
  CDS Start-End: 1-1371
atgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgtaagtgcatattgctttataaacagtaaatagctctaccaatgtaacagactaagaaaatgaacaatttagtgacagttagaaaacaatgagtgtgatgaaaaatacggcaataaaatgaaagtaaaatgtaa

SEQ ID NO: 135085 - DNA, 2285 bp, Homo sapiens
  Payload ID: 6402
  Gene Symbol: FOXP2
  Gene Name: forkhead box P2
  Uniprot ID: O15409
  ENST ID: ENST00000393489
  CDS Start-End: 383-2254
ttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaaggg

SEQ ID NO: 135086 - DNA, 6085 bp, Homo sapiens
  Payload ID: 6402
  Gene Symbol: FOXP2
  Gene Name: forkhead box P2
  ENST ID: ENST00000393491
  CDS Start-End: 651-2243
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctgctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaagaaaactgtctacctctaacaccagggagttatcagattttattttacatagttttagtctacaaagacacaattgcttaaacctagtgggcttaaggcttatattctatgtggttggattcgtggcacagttgtactatttgaaaatcaattaaaattttatgtgaatgttacaagtatttggtagaattaccactaactgggttttctttagataactcagatatggagaaaatgtcatcagcattctgtgtctacagctgcttaacttcataagaatgcatttctttgtgattagggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccattt

SEQ ID NO: 135087 - DNA, 2664 bp, Homo sapiens
  Payload ID: 6402
  Gene Symbol: FOXP2
  Gene Name: forkhead box P2
  Uniprot ID: O15409
  ENST ID: ENST00000393494
  CDS Start-End: 280-2427
tgcatctgctgtgtacagacttggctttgtactcttttcctgggggagagaaagtctttcttctctgctagttgattcctgtttttgtgaaacagctaagaaaacatctgtggcaggcagaaaaattgacaaaggattgacaaacaccattagctgaaaattttccatttcattgcaactatgcattgtttactttactgtaaatatcttaatacatcatcctctgaatatgctggcagagaagctggagaactgtgatttcaattaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaa

SEQ ID NO: 135088 - DNA, 772 bp, Homo sapiens
  Payload ID: 6402
  Gene Symbol: FOXP2
  Gene Name: forkhead box P2
  ENST ID: ENST00000393495
  CDS Start-End: 260-772
gttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtg

SEQ ID NO: 135089 - DNA, 2617 bp, Homo sapiens
  Payload ID: 6402
  Gene Symbol: FOXP2
  Gene Name: forkhead box P2
  ENST ID: ENST00000393498
  CDS Start-End: 314-2398
attttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttt

SEQ ID NO: 135090 - DNA, 6415 bp, Homo sapiens
  Payload ID: 6402
  Gene Symbol: FOXP2
  Gene Name: forkhead box P2
  Uniprot ID: O15409
  ENST ID: ENST00000403559
  CDS Start-End: 375-2573
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaagaaaactgtctacctctaacaccagggagttatcagattttattttacatagttttagtctacaaagacacaattgcttaaacctagtgggcttaaggcttatattctatgtggttggattcgtggcacagttgtactatttgaaaatcaattaaaattttatgtgaatgttacaagtatttggtagaattaccactaactgggttttctttagataactcagatatggagaaaatgtcatcagcattctgtgtctacagctgcttaacttcataagaatgcatttctttgtgattagggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccattt

SEQ ID NO: 135091 - DNA, 6443 bp, Homo sapiens
  Payload ID: 6402
  Gene Symbol: FOXP2
  Gene Name: forkhead box P2
  Uniprot ID: O15409
  ENST ID: ENST00000408937
  CDS Start-End: 375-2597
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacctctgcaaaaaaaaaaaaagaaaaaaaaaaaaagaaaaacattagaacaattatggcagattgcatgaaacgtgagaacgtcacagtaactgctacttttcattatgtttgtctttgggtcatgatcaacgaaccggaagtttacaatatggtattaaaagaaagatgggtatggtgaaagatggttttcagtcatctaggatcctactgtaaggattatctgaaaggaaaaatgggtctttcaggtgcatgttcaaaaggctttgagggactggaagtaactgcgagagttgtaccatcagaagggtggcctaagactacaatgctaaagtatgcatacctcagttagaaaacttttgaaaggaagtctcagccacagaatgcatatacctgtagagttttgcatgggttttatatgaatacaattttaaaaaatagctgcttgcacattataccagaaaaacctccaaaactgcaattgctttgaaaatagattttaggttttttggagtttcctgaaatgcttggtctgtattttgataattgtgcatattatgtaaaaatgttggtggacccataaatgaccagactttttctaagaaaaatgttgctttaatgcatttcatgaatttttactcttatatcattgcttgctagtaatagcaaatctgcttttctgcatctgctttgcgtagctattgtaaggctttgaactaatgtatgtatttattgcttgaacttctgtgcataccttataaagcataatgtctgacaatttaaatggctcatgtattcttgcttctatcataagctgattatggggactatgatcttttgtatacagcaaattttaaactgtagcacaaacatctgtttatgtattggtggaatatacctgttttatttatcttttttgaggtaaactaatttttgatacttttcattactgtgtactatgttcatactttgaattctctgacgttagaagtcatggttgagaattgtaacagctgttattcgttctgtattcatggctttcactgctgaataaaataaaggaccaaacctaggatttgaaagaaaactgtctacctctaacaccagggagttatcagattttattttacatagttttagtctacaaagacacaattgcttaaacctagtgggcttaaggcttatattctatgtggttggattcgtggcacagttgtactatttgaaaatcaattaaaattttatgtgaatgttacaagtatttggtagaattaccactaactgggttttctttagataactcagatatggagaaaatgtcatcagcattctgtgtctacagctgcttaacttcataagaatgcatttctttgtgattagggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccatttataa

SEQ ID NO: 135092 - DNA, 1509 bp, Homo sapiens
  Payload ID: 6402
  Gene Symbol: FOXP2
  Gene Name: forkhead box P2
  ENST ID: ENST00000440349
  CDS Start-End: 420-668
cggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcgatcaaacaaataatagaagtctgttgaagctttgtcctgacctatcctggaagtagaagaatactctggagaaaggagcattgtaagcacaaagaataagattcctcaatcctgagagagagaattaaagtctaactctccaaatgtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctggagtgcagtggtgcaatcataactcactgcaacctggaactcctgggctcaagcagtcctccgacctcagcctctgaagtagctaggactacaggaggatgttgtctcttacacccaggttatttgttaaagtctttggatctatacttaactgatgacctagaagagcgattctcaaaagtgtgagtcctggaccagcagcaacagcatcaccgggaacttgttagaaatgcacattctcaggccactccctagacctactgaatcagaaaccctggggttggagctcagcaattaccctgcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaattcaaaatggtttattcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccag

SEQ ID NO: 135093 - DNA, 3495 bp, Homo sapiens
  Payload ID: 6402
  Gene Symbol: FOXP2
  Gene Name: forkhead box P2
  Uniprot ID: O15409
  ENST ID: ENST00000412402
  CDS Start-End: 387-650
gagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcggtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggaattgcttccagaaacaaaattatgtatctgtggccactcttctggtgatgggcatcctcacaacacatttgcagtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaac

SEQ ID NO: 135094 - DNA, 625 bp, Homo sapiens
  Payload ID: 6402
  Gene Symbol: FOXP2
  Gene Name: forkhead box P2
  ENST ID: ENST00000452963
  CDS Start-End: 11-625
gtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagtcaaaatggtttattcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagag

SEQ ID NO: 135095 - DNA, 8301 bp, Homo sapiens
  Payload ID: 6402
  Gene Symbol: FOXP2
  Gene Name: forkhead box P2
  Uniprot ID: O15409
  ENST ID: ENST00000441290
  CDS Start-End: 487-750
gccgccgcgggtgccacctcccgggacgctgcccacggcgtccccggtcgcgatcaaacaaataatagaagtctgttgaagctttgtcctgacctatcctggaagtagaagaatactctggagaaaggagcattgtaagcacaaagaataagattcctcaatcctgagagagagaattaaagtctaactctccaaattttcaacaggagttttgagtaaagaaaatggagaagtttgtgggagagaaaggtctactctaatgtgatgctgggattgaattttcctaggactccgtttcaaggttaattcgaaagtcttgtggaagatctggaagaaacagccagtactcatatatatagaaagaggagttggatgtttgtcaataaactcatctggctttaaataaatcaaaacaaaaagaataatttgctactagtcttccaacatgtttgaagaacagcctgctgtttggggaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctaatatttgcaaagtcacatacagatgcatatggatgtttctgcgtttctcaaactatgcagaggtgctcttgtacatcccagagaagcttacaccagtggctttgtaaatgtattaaatgcagcatttaggagcattatctcagctttcatttatctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatgtaagtgtggttaacagactctctaaagggaagaatctatattaatatgcttcttaaatttagaatttttccgaagtttttactgttgtataagttgaaaatacaaatttaagtggagttaaattataccacgttcataatatgacaaagtttatcaaaatcggttttaatacattttttagatgatctcaaatgccatatcattattgttccagcagtcctctacagattcttagtactactaatgttctcttgggcataaagcagtgtctaagatgaatctacatcttatgggtcattatcacaggttggtttgtatggtgcaataagaatattcatgatggaataagttgttataatttttactactgttacaggtctctaaaccatttatgaactgtagtcaagatattgcccgtttttataaaccgtaaaatgcaaagtttaactgttacccacagtttacatagaagctagtaaagtgtaactttttgcctgtcttataaatcagtgtaattatatattcaactttaattactggtgcgtctgtattggcaaggtttataagttatattttatgcaagactacgattcctattaatatttagcagctaactatatcattaattactctaaaatctttcccctaccatctttttaatggagctgagagagtagaagtattaaaaattgatgtattgtggatttcagaaatgtgtatgacactttaaaaaatgcctggcttttttcaatagtgtcaagcatattagtgtcttgtttactaaaatgtattgaccgtggtagaactcagaattcagaggaaaaaaatttgaatctgaataatgaagtgtgtacaccatttagctgtcaggatgagttgtaactcatgtctatacttcctagaattaaacgtcacatacttctaattacaagttattgaggtaagattagtcctttctcttatttttatattgtcttcctttatttttccattcaatatctagtaaaaggtctgaaagagaaatatactctttatatgtacccattttcacttgacctttcacagggtattatttttgttgtctttttaaacattttattctgtttgacatattaatgtctttaagagcatatgtctaattgctttatagcacttttactctatcacctttgcaaaaaaacacactgtgaacattaatgtgttttatcaggttccgaaccattacttcttcaaaatggaaaaatttgtcttttggaagtgtctttagatgtattaaataatacaaaagaagtaataaaactcaaagtagaaagaacatgaatatatgctcttgagagtagcagtattctaaaacaaggaaagtgagcaatcagacaaaagtttttatatccccgctttatcctatcagccatgcagtgggtagcttgcggccttttactttcagcagttctcctgagtatgctaaatagtttattaaacattatatttcagaacctgaaataataattgggctaaattgtagcattgttagatgggtattggttttcgtttggcaattgctacttcagatttttcattttattattaaagtttatgaaatatttcagagaaatattagtatgtattagataacacctaaaaattatacatataatgtccagtatattgctgctatgggtttataaagttaaaatgttcatagttaatatataacacattttatgcttatatgaattagtgcatttgaaaaatacttatgtttattttccatagataaaaggaaagcttgttgaaaatagatttcagaaaaaataaaaattaaaaggggtgtaaattgtccctttttctaagttacatcaattataatcaaaattttaattatcttgcagaatattgagtcaatattcattcttaaatctgtttctgctgctgtcattaggtttttgcataatagatgtcaaatatttatgaaatatttcagtattctctatcttcacctttataaagttctaagatgcttgtacttaaaccatgttatgtattttattaggcaaaggaagaaatattgatataattctctcagtcaaaatttggttgtatataattgagtgcatttcaaaatactttggaaattaaacagaagtgaaataatttttataagacatttacacagcatacttatatctcctaaaatgaagtcatgttacttgttgttttagaggggggtagttgtgctgatgcaattgtaaacaagaggaaatagggcctagtggtatcagaacataggttgtaatgccagactgtcagggttccaattccagattcaatagttaatagccaagtgggattgagcacgttacttaatatttctttcctcagctttctcagctgaaaatgaggtaagtaataatataatgcttcttatttcataagattcttgcaaagaaatgagtgcctggaacataataattgctccttgtgtctctcatagtgctgtgtaaataggtactgatttatattacttcctgtaatacctcactgttactaaaaatgagtctataaacaatatgaaaatatttttgtattttgcattttaaggcactctgtaagtttgtggttagtcattgacaatccattttcttctccttctttcttctcttataattcataaagtaagcagatccataaaactgaaacaacatgaggccaggcatggtggcttatgccagtaatcccagcattttgggaggggagggcaggaggattgcttgaggccaggagttcaagaccagcctggacaacatagtgagaccctgtatctacaaaaataattttaaaaattagttgggtgtggtgtgtgcctgtatacagtcctagctactcaggaggctcaggcaggaggaaagcttgagcctagggatttcgaggttacagtaagctatgatcatggcatggaactccagcctgcaccacagagtgagactctatctgtctctaaaaataaaaagtgaaacaatatgacacaaggacttattataggtagcacattacctatatttaggtatctgaagttacctagttatctgaagttttaggcaatgaacaactcaaatagaacaacaccaacccagaatcagggacatatcatatatgtcttgaaaacattgagtattagttttgaaaggaatttagaatacataagggaatacagaatttagaatataggaagtgggaccagactgctgagtgacttaaatatcaagctatggtgtttgtttcagtcagtatacagcttgttactgttatcagcttgactttgacacgatcagagctatgcattagaaacagtaatctaaaagtgtactgaatgaaccatgacttaatgaaactcatgtataggagaatattctgaaattgggagagactggaagcagaaaattaattcttgcagtatgtaatatctaacataaatacaagactaggagtggagagcaaagaatccgtataagaagtgctgtgaaaagaaatactggaacaagacaaccaactgaatgctagggacaaagatgaaaattgggaaaattcatagccactttaaaagtctgcaaagagaaatagaggacacaagaagcaggttcaaaagggaagatgaagaattcagcattttacttggggaatctaagaacctaaatatcattagattcaggagaaaacactgatgatttttttgattagtcttttaattcaactccattatagtaaaattctacgtggtagaatatgaatatatacctgaggttgatagagaagatgttttttgaagcattagaagagtgaaatagatatggtctggtgcttcttataaattgtggagaacaagagatgccaaattatcatttatattccatactccatattttaacccttttcttccactccagttttcgctttattcagtgtcctgaataaaggcctcttccaaattaatgcatttatttcgctcacactatttgaatttctgccctttcccttttctggttcccctctactctcttacctaaattctacctttccttacaggactagtcctatttttttccaagagggtttcccaaggaattttactatcaggaccatgcactctgctccacacttctaaagagcttgcttcttataccactattttggactaatactttgtgtacatgtgtgagtgtgtgtgcacacacacatgcacgtgtgtttatgcatacatctgtgttcattttgcagatatccctaccttaatgacaagtcccttaaagacagattatgttttagacaaattatagtataagaaacccctagcacattctactatgtcaagtaagcattcagtaaaagtatgatactgattatgaagaatcaaattggagattacagttaattagaaatggtttgacttcacaaagtcatacttacaggagtataaaatccagggttctcctagaatcttgaagaaggagaacaaaagagattttaggaagaacagatgagtaaatataatgttcatttttatgtgggagctaggaaaattttctaaatattggtagactatactttttaagttttatttttagttttaattatttaattaatatgtattttataaccattccaatttacgtgagtaaaaagtggctttccactttgagtagaatgaggccccttcacctcattcatgattatcatctcaaccttgttaaattttatttacattgttgaaagattgaaaacaattatcaaaatttaggcaatataaatcagatgaatgtttaaggggatttcagcaaaaagtaggaaaggttaaagccaggcgacattgtatagattctacataataattttttgaaacttctttgactgttttgactcaactacttattgattcaaagcaagtacttcacttttaaaacatttttattttctattgctgttcaaagagtcctagaaacatccatggtatgaataaaggaaaacgatactttaagtgtccgagctgagtatcattacaatttataatattgttcccttatgcacctgaatgccaatattccctttttcagagttatatagaatatgaattaaaaatgactagcttcctattttatatagacatttacctctagaaatgtttaaaaggttaggattgatgctgtctttaagcagaaataatttgaacttactgtcttctctcatgtgttggacttaagtgaatgacaagagaagaaaacatgtagactagacttggaagatgaacgcatactgatacaatcaatccatttcctgtctacttcccaacctaaggcaagaagtggaatttaatgatgtacccaccatgtttagttctactcagttgtttctttttgtattaagtaattgtttctcctcattctcaataagttggttcagatttgctgttcttcctcgtataaaatgttaaatgagattcccatttttatattttcaaatgttgtgtctagagatcaaaataaatattcttcccta

SEQ ID NO: 135096 - DNA, 1388 bp, Homo sapiens
  Payload ID: 6402
  Gene Symbol: FOXP2
  Gene Name: forkhead box P2
  ENST ID: ENST00000462331
  CDS Start-End: 375-578
cttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggaggatgttgtctcttacacccaggttatttgttaaagtctttggatctatacttaactgatgacctagaagagcgattctcaaaagtgtgagtcctggaccagcagcaacagcatcaccgggaacttgttagaaatgcacattctcaggccactccctagacctactgaatcagaaaccctggggttggagctcagcaattaccctgcaggtaattctgatgcatgctcaagtttgagaaccactggcctagaagaaatgaactactgcaacttatgaggaatcatgagatccagctcacttttgctcaatacctatcaaaagcttgtcccagagtgattatggaggattgcatgcaggatacacacttcattaaatcctctaaaatctaactttgattaattaagtacagggttattgctgatagcctcataactctaccaccattataatggatctatataaaattgcttaatatcagtagcctaaatttaggagcactatagttttaaaaatacttaattggctactttatttaacaatgttttagggatgtcgttcagtatcttttccagtgtttgctacctaagatcccattggggtaaaaatataactcagatttcactgttaggaatagttctgtttgtgagcaacttacttcctttcatcttacacaatgaaccttgtaatttaattatgattttctcttcatacgagctgttagaaagctcagcattaaatttgtggctcacctctagcaaatatataacacttaatgatgtgactgtcctgattctaaaactttttctcttggttttttactttttaaataaaaacacatttaac

SEQ ID NO: 135097 - DNA, 1858 bp, Homo sapiens
  Payload ID: 6402
  Gene Symbol: FOXP2
  Gene Name: forkhead box P2
  ENST ID: ENST00000634623
  CDS Start-End: 90-1858
gtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgc

SEQ ID NO: 135098 - DNA, 685 bp, Homo sapiens
  Payload ID: 6402
  Gene Symbol: FOXP2
  Gene Name: forkhead box P2
  ENST ID: ENST00000635563
  CDS Start-End: 1-685
agcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcg

SEQ ID NO: 135099 - DNA, 2598 bp, Homo sapiens
  Payload ID: 6402
  Gene Symbol: FOXP2
  Gene Name: forkhead box P2
  ENST ID: ENST00000635638
  CDS Start-End: 339-2489
gtgtggaccctcacttgctgtgggtgttggggcctctctagagcagggaggaaaagttaccctcactattctcagactctggaatctcttagatcaaacaaataatagaagtctgttgaagctttgtcctgacctatcctggaagtagaagaatactctggagaaaggagcattgtaagcacaaagaataagattcctcaatcctgagagagagaattaaagtctaactctccaaatgtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatg

SEQ ID NO: 135100 - DNA, 4065 bp, Homo sapiens
  Payload ID: 6402
  Gene Symbol: FOXP2
  Gene Name: forkhead box P2
  ENST ID: ENST00000634411
  CDS Start-End: 150-2246
aagattcctcaatcctgagagagagaattaaagtctaactctccaaatgtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatac

SEQ ID NO: 135101 - DNA, 4290 bp, Homo sapiens
  Payload ID: 6402
  Gene Symbol: FOXP2
  Gene Name: forkhead box P2
  ENST ID: ENST00000635534
  CDS Start-End: 153-2291
gagcttgtttatgatgcaagccagtataaacacagtcggaggatgacacagatagctgcacttttcccagtgacatgagcaagttcttactgcaacaccaacagctttttcctctgaccagtttgacattcttcaccttcaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggattttttggattctggattggaaaatttcagagctgccttggaaaaaaatcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaaaggtctagtaaagccaaaaattaatttcatattgattttaaagtgatctagctgagtttttacactgaaagcaaagattatagcaattgtagtccatggtatttattttcagtcaaaccaaagttacatataattctgcctctgcttatacgggatattaacactaacaatacactcccttcaaagacttgcacaggccaaattgttggaatgctggttttcttgacaattccaaaccccaaaactatgataatgagttatgatgtagttgaaaatagcatagtcagatgtttgcttaaaacctagaaacttaacatgttgcttttcatgtgctgtgccaagtcttgataatactttttcccccaaccaagggacctcataacctgattatggttattgctttacaaacagttttgacagaaggtggctgctagagcttaacatacgttcccgttccatgtgatggaaccggttcttgcaaactaagctcatcattgattctttgctgaagtcagcaaatagagttagagagatacccagtcatctatcacaccaaataaaaggacataacggctttcaaaagggttttcccacttacccaaaaggctttctgaaagcttctacct

SEQ ID NO: 135102 - DNA, 2504 bp, Homo sapiens
  Payload ID: 6402
  Gene Symbol: FOXP2
  Gene Name: forkhead box P2
  ENST ID: ENST00000635109
  CDS Start-End: 102-365
gtctactctaatgtgatgctgggattgaattttcctaggactccgtttcaaggttaattcgaaagtcttgtggaagatctggaagaaacaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcagccatgagacagacttgtggttcttcaacagctgtgcagagcagagacgtaaatttaaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttc

SEQ ID NO: 135103 - DNA, 1326 bp, Homo sapiens
  Payload ID: 6403
  Gene Symbol: FOXP3
  Gene Name: forkhead box P3
  ENST ID: ENST00000376197
  CDS Start-End: 1-1326
atgtcccccatctcaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 135104 - DNA, 2274 bp, Homo sapiens
  Payload ID: 6403
  Gene Symbol: FOXP3
  Gene Name: forkhead box P3
  Uniprot ID: Q9BZS1
  ENST ID: ENST00000376199
  CDS Start-End: 189-1379
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctcccc

SEQ ID NO: 135105 - DNA, 2382 bp, Homo sapiens
  Payload ID: 6403
  Gene Symbol: FOXP3
  Gene Name: forkhead box P3
  Uniprot ID: Q9BZS1
  ENST ID: ENST00000376207
  CDS Start-End: 189-1484
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccaca

SEQ ID NO: 135106 - DNA, 2448 bp, Homo sapiens
  Payload ID: 6403
  Gene Symbol: FOXP3
  Gene Name: forkhead box P3
  ENST ID: ENST00000455775
  CDS Start-End: 189-1553
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctcccc

SEQ ID NO: 135107 - DNA, 1213 bp, Homo sapiens
  Payload ID: 6403
  Gene Symbol: FOXP3
  Gene Name: forkhead box P3
  Uniprot ID: Q9BZS1
  ENST ID: ENST00000518685
  CDS Start-End: 23-1213
cctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 135108 - DNA, 1371 bp, Homo sapiens
  Payload ID: 6403
  Gene Symbol: FOXP3
  Gene Name: forkhead box P3
  Uniprot ID: Q9BZS1
  ENST ID: ENST00000557224
  CDS Start-End: 1-1371
atgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 135109 - DNA, 3745 bp, Homo sapiens
  Payload ID: 6404
  Gene Symbol: FOXP4
  Gene Name: forkhead box P4
  Uniprot ID: Q8IVH2
  ENST ID: ENST00000307972
  CDS Start-End: 13-2055
cgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 135110 - DNA, 3300 bp, Homo sapiens
  Payload ID: 6404
  Gene Symbol: FOXP4
  Gene Name: forkhead box P4
  Uniprot ID: Q8IVH2
  ENST ID: ENST00000373057
  CDS Start-End: 237-2273
gcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaa

SEQ ID NO: 135111 - DNA, 5948 bp, Homo sapiens
  Payload ID: 6404
  Gene Symbol: FOXP4
  Gene Name: forkhead box P4
  Uniprot ID: Q8IVH2
  ENST ID: ENST00000373060
  CDS Start-End: 459-2501
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatg

SEQ ID NO: 135112 - DNA, 5910 bp, Homo sapiens
  Payload ID: 6404
  Gene Symbol: FOXP4
  Gene Name: forkhead box P4
  Uniprot ID: Q8IVH2
  ENST ID: ENST00000373063
  CDS Start-End: 459-2462
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatga

SEQ ID NO: 135113 - DNA, 3341 bp, Homo sapiens
  Payload ID: 6404
  Gene Symbol: FOXP4
  Gene Name: forkhead box P4
  ENST ID: ENST00000409208
  CDS Start-End: 312-2318
ggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaacc

SEQ ID NO: 135114 - DNA, 367 bp, Homo sapiens
  Payload ID: 6404
  Gene Symbol: FOXP4
  Gene Name: forkhead box P4
  ENST ID: ENST00000451305
  CDS Start-End: 105-367
ctggctgtgtgccccagattctactgtttcctgtctgatcccacaccttctgcattctcctttttcttctggagaatgagcccctcccgtggaggagccatggcatggagggagagttggggcccgcactctccagaggggaggcttacggacatcacaccagttcataccagctgctggggaatgctcagaaactgccctttcctccttggcctgacacagctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaaca

SEQ ID NO: 135115 - DNA, 1715 bp, Homo sapiens
  Payload ID: 6405
  Gene Symbol: FOXQ1
  Gene Name: forkhead box Q1
  Uniprot ID: Q9C009
  ENST ID: ENST00000296839
  CDS Start-End: 233-1444
ctcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggacttt

SEQ ID NO: 135116 - DNA, 1159 bp, Homo sapiens
  Payload ID: 6406
  Gene Symbol: FOXR1
  Gene Name: forkhead box R1
  Uniprot ID: Q6PIV2
  ENST ID: ENST00000317011
  CDS Start-End: 226-1104
aaatggaccgctccacacctgagctgccgccaagctaactcaatccgagccggcgcatttgagaaggcgcctgtgagggtcgctcctcagccgccgcgctcccactccgcgtccccactccgcgccgccgcgcctctgccagccccgaaggtggacgtgaagctccaacacctcgacttctgggcccgcctccatggccaggtcccgggactgctggactgggacatggggaacgagctctttctggccttcaccacatctcacctccccttagcggagcagaaacttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcgaaagcacttcccctttttccggacggccccggaaggctggaagaatactgtccgtcacaatctctgttttcgagacagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctttaaccccaagaagcaacagccagctaatgctttattaaaattaccctcactagccttc

SEQ ID NO: 135117 - DNA, 409 bp, Homo sapiens
  Payload ID: 6406
  Gene Symbol: FOXR1
  Gene Name: forkhead box R1
  ENST ID: ENST00000533282
  CDS Start-End: 1-409
cagttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagaaagcacttcccctttttccggacggccccggaaggctggaagaatactgtccgtcacaatctctgttttcgagacagctttg

SEQ ID NO: 135118 - DNA, 1053 bp, Homo sapiens
  Payload ID: 6406
  Gene Symbol: FOXR1
  Gene Name: forkhead box R1
  Uniprot ID: Q6PIV2
  ENST ID: ENST00000531539
  CDS Start-End: 221-841
gaccgctccacacctgagctgccgccaagctaactcaatccgagccggcgcatttgagaaggcgcctgtgagggtcgctcctcagccgccgcgctcccactccgcgtccccactccgcgccgccgcgcctctgccagccccgaaggtggacgtgaagctccaacacctcgacttctgggcccgcctccatggccaggtcccgggactgctggactgggacatggggaacgagctctttctggccttcaccacatctcacctccccttagcggagcagaaacttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcggagctgcttggcctgattctgctttgttcatgctgtggtccaagccctgggccctcagagggagggagggttcagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctttaaccccaagaagcaacagccagctaatgct

SEQ ID NO: 135119 - DNA, 1159 bp, Homo sapiens; identical to SEQ ID NO: 135116
  Payload ID: 6406
  Gene Symbol: FOXR1
  Gene Name: forkhead box R1
  ENST ID: ENST00000626640
  CDS Start-End: 226-1104

SEQ ID NO: 135120 - DNA, 409 bp, Homo sapiens; identical to SEQ ID NO: 135117
  Payload ID: 6406
  Gene Symbol: FOXR1
  Gene Name: forkhead box R1
  ENST ID: ENST00000634385
  CDS Start-End: 1-409

SEQ ID NO: 135121 - DNA, 1053 bp, Homo sapiens; identical to SEQ ID NO: 135118
  Payload ID: 6406
  Gene Symbol: FOXR1
  Gene Name: forkhead box R1
  ENST ID: ENST00000634955
  CDS Start-End: 221-841

SEQ ID NO: 135122 - DNA, 1926 bp, Homo sapiens
  Payload ID: 6407
  Gene Symbol: FOXR2
  Gene Name: forkhead box R2
  Uniprot ID: Q6PJQ5
  ENST ID: ENST00000339140
  CDS Start-End: 313-1248
ttcctcttgaagtgactttctgcttccaatcaaagctcaagaattccacctaaaaatgtttttctgctcaaaagctcttttttattacttccatgttttgagccttgttccagaaagctgaggtttctccaggtctgaccactaatcagtgagacattggtgcctctttcttcagtgcttctagcaggcctactgataagctccctagatgagatacactgcataaaaaaatgatgcccaaaggacagctttaagtgcctgctagatatctgttctttcagaagtctctctccacctatctctccagtaaagatggacttaaaactaaaagactgtgaattttggtatagtctccatggccaggtcccagggctgctggactgggacatgaggaatgagttatttctgccttgtaccacagaccagtgctctttagctgagcaaatccttgccaaatacagagtcggagtaatgaagcccccagaaatgcctcagaagaggagacccagtcctgatggagatggtcctccctgtgaacccaatctgtggatgtgggtggaccccaatatcctgtgcccccttggcagccaggaggccccaaagcccagtggaaaagaggatctgacaaacatttctcctttccctcagcccccacaaaaagacgaagggtctaactgctcagaggacaaagtggtagagtctctgccatcttcctccagtgagcagtctcctttacagaagcagggtatccattcccccagtgactttgagctcacagaagaggaggctgaggaaccagacgacaactccctccagtcccctgaaatgaaatgttaccagagccagaaactatggcaaatcaacaaccaagagaagtcctggcaaaggccccctctcaattgtagccaccttattgccctagcattaagaaacaacccccactgtggcctcagtgtgcaggagatctacaatttcacccgacagcatttcccctttttctggacagctccggatggctggaagagcaccattcattacaacctctgcttcctggacagctttgagaaggtgccagacagccttaaggatgaagataatgcaagacctcgctcttgcctttggaagctcactaaggaggggcaccgccgcttttgggaggagactcgtgtcttagcctttgctcaaagggagagaatccaagagtgcatgagtcagccagagttgttgacctctctctttgatctttgaaatgccattgctcccttttggaacactgccttccttactgtgcctacttatcccctgacattcattaatctctaaacttacccagcctggttggtgccaagtctgtctttagctactgttacaataatggtgttaagtaaagttagaggtgggtacaggggagacagaacttaaatccaggtggagagtcatggaaagtcgcacgaggagagtggctgttgttccaaattttgagcaaaggaaaagaaatcctagaaacaatggcatagaaactaaggaaagaagggtgtgttttgtgaaagaaaggaattttgtttatagagagtattttcacacatgaaagtgaacagtggaatataaagcataaaaggcaggatggagccgagccatggagaacctcgagtgccatgtgaagagaatttgacttgtgatgaagaatcaagtttccccttctaccattcatcagctacatctcctttttaagtaacccattttatccttcagaacctcacttttctatttctggccctggacttctaagccttgtttctttgtcatccaattccaatattgacaaataattctaaacagctacttttagtttgtatgtttaacgtcctgtgaaatattcctgtattaaccccaagccttttgatgataaagctttattttctatta

SEQ ID NO: 135123 - DNA, 1319 bp, Homo sapiens
  Payload ID: 6408
  Gene Symbol: FOXS1
  Gene Name: forkhead box S1
  Uniprot ID: O43638
  ENST ID: ENST00000375978
  CDS Start-End: 78-1070
ggcaggctattccggacgccagccctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaacctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggccacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtccctcaccctccgggctgagcctggctctaggacctgaagaactctcgaaggacccagccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgagg

SEQ ID NO: 135124 - DNA, 2657 bp, Homo sapiens
  Payload ID: 6409
  Gene Symbol: FHAD1
  Gene Name: forkhead-associated (FHA) phosphopeptide binding domain 1
  ENST ID: ENST00000314668
  CDS Start-End: 1-1944
attacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctt

SEQ ID NO: 135125 - DNA, 5090 bp, Homo sapiens
  Payload ID: 6409
  Gene Symbol: FHAD1
  Gene Name: forkhead-associated (FHA) phosphopeptide binding domain 1
  Uniprot ID: B1AJZ9
  ENST ID: ENST00000358897
  CDS Start-End: 139-4377
gggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctt

SEQ ID NO: 135126 - DNA, 785 bp, Homo sapiens
  Payload ID: 6409
  Gene Symbol: FHAD1
  Gene Name: forkhead-associated (FHA) phosphopeptide binding domain 1
  ENST ID: ENST00000375995
  CDS Start-End: 8-763
tcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaaggttactgggactttttttctcacatggttgcatgactctaaaatgtcgcgttgaatc

SEQ ID NO: 135127 - DNA, 1459 bp, Homo sapiens
  Payload ID: 6409
  Gene Symbol: FHAD1
  Gene Name: forkhead-associated (FHA) phosphopeptide binding domain 1
  ENST ID: ENST00000375997
  CDS Start-End: 26-976
taagaagtgcttttcgcctcccaccatgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaaggttactgggactttttttctcacatggttgcatgactctaaaatgtcgcgttgaatctcagcatgatgggacatctgttgaggaagtcttcctgggtatctggccaagtctattcccttctccagaaccccctgcttctctgcttgaggcgtaattttccattaaaaaaaaaaacacacacatacaagtgagacacgataactgaagaaaaatgaaacaaaacagaggcaaaaggaaaattaaatcgaaattatgcaaagtctaattacgctgtttaacctccaaggcattttcccatggaaataaccgcgtgattccaggcaagtgacttaccctgtctatgcctcagtttccctatctgtaaaatgaggctaatagggagtacccaccctttagggctgttgtgatcattaaaatgcatgaatatatggaaagtacttggaatagtacctggcacacaataggcattactgaatgtttattgacttttaatttgacaaaaaaatagtgtcacgtta

SEQ ID NO: 135128 - DNA, 4355 bp, Homo sapiens
  Payload ID: 6409
  Gene Symbol: FHAD1
  Gene Name: forkhead-associated (FHA) phosphopeptide binding domain 1
  Uniprot ID: B1AJZ9
  ENST ID: ENST00000375998
  CDS Start-End: 1-4239
atgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttacccta

SEQ ID NO: 135129 - DNA, 3481 bp, Homo sapiens
  Payload ID: 6409
  Gene Symbol: FHAD1
  Gene Name: forkhead-associated (FHA) phosphopeptide binding domain 1
  ENST ID: ENST00000444385
  CDS Start-End: 1-2081
ctcagcagtctttactgcaggaaaagctgcgggagcatctggcagagaaggagaagctgaacgaggagaggctagagcaagaggagaagctcaaagccaaaatcaggcaactgacggaagagaaggcggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagtagatgggagcttccagcccctgcctcgcagacagatggtgaggatgaaagaatgcaggcatccctcgctatctgctgtccactctcgctgtcgtcatacctcaggagccaagtgcttttggatggtgagggtgcttgtcccgtctctgaagcacctgcccagggcctggcaccagccggcggacactgccttccccatgctgcccatgacccatgctgcccgtgacccatgcaggtggtctcctgggtgagtcctgcctcagacccggtagggtctacacactggaaagtttccccaaagcaagtcacacatgagcagcacccgggcggcttccaaagctccctgaaagctggcagaggggctttcctgtctgctttgcagttgacatattcatcatccactcctgcagtccacaaggcactggaacagtgacctctaaatagagccagactctccctttccttcactcttgcctaaggtggagcagatcccaaggctggggttaggcaagtcagggaaagaaccacagtcactgtttcttcatgaccgtctccaggccagggactgggctcacctgagctttgcagccgtgatagggcttattaatgcctctaatagccctgcctggtacgatgatccctattttacagatgaggaaactgcgcctcagagagttaagaggcgcccaagtgcacacagcggctggtaaggacagctgggacctgaccccagatccctctgaccctggttctcctgctgtctgcagggttggccgtgagtcccctccttgtaactgtcagcttttatgtgtgtgtgcattctcgtgtgtgtgtacattctcatgtgtgtgtgtgtgtgcacatgtgtaccatgtgcatgagggtttggctgtgtgtgacactatgtgtgtgtgtttgtgtgtgttgcctgcctgagctcagagagagccaaacccccagagaagggtgccccctccaccaaccaggtgagctccttgcagaggcctggccttcatcccacaaaccttgcagaccacaggctccctggcttgcagcccccaaaaatgaaggcagcgctctgctctggacgtggcctttccagcactcaccactctgaattaaacatcacaggcccccatctgcacatgtcgtggggctgcctcgggcagaggaccgtttccttttacgctgtgccatgccagggagatctgggcagcagcagagtcctgagatgtcctttgatgtacccacaggagagttcgctccttcccgaggcagtgtcccccagggcttggcaggccaggcccacagcagagacaccaaaccacagaatgggacggcagagggccctaaaaagcccattgtcatgcactggctgaaaatgaaagaaaacctgcagattt

SEQ ID NO: 135130 - DNA, 570 bp, Homo sapiens
  Payload ID: 6409
  Gene Symbol: FHAD1
  Gene Name: forkhead-associated (FHA) phosphopeptide binding domain 1
  ENST ID: ENST00000433640
  CDS Start-End: 1-570
gctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacaggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagattta

SEQ ID NO: 135131 - DNA, 2338 bp, Homo sapiens
  Payload ID: 6409
  Gene Symbol: FHAD1
  Gene Name: forkhead-associated (FHA) phosphopeptide binding domain 1
  ENST ID: ENST00000481324
  CDS Start-End: 1-1411
tgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgaggaaactgcgcctcagagagttaagaggcgcccaagtgcacacagcggctggtaaggacagctgggacctgaccccagatccctctgaccctggttctcctgctgtctgcagggttggccgaaagtgtagaggagcacgaactgagaaacgcaaaagaatcgacaccttgcaactgtgccttcaaagagaaagacaggcaggccctgccccacctgcctgcagtttgaacggatgacctaagagacaagcacgcgtccagccccgtctgtccattaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtcttt

SEQ ID NO: 135132 - DNA, 2434 bp, Homo sapiens
  Payload ID: 6409
  Gene Symbol: FHAD1
  Gene Name: forkhead-associated (FHA) phosphopeptide binding domain 1
  ENST ID: ENST00000529606
  CDS Start-End: 1-2106
attactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttc

SEQ ID NO: 135133 - DNA, 378 bp, Homo sapiens
  Payload ID: 6409
  Gene Symbol: FHAD1
  Gene Name: forkhead-associated (FHA) phosphopeptide binding domain 1
  ENST ID: ENST00000524761
  CDS Start-End: 19-378
tgcttttcgcctcccaccatgattctgaggcctccccggccatgtggaacttgctcggtgctaaaggaagagttaaaacaggaagatgctcacagggagctcagggaagcccaggagaaagagttaaaactctgcaaaaccctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccag

SEQ ID NO: 135134 - DNA, 1905 bp, Homo sapiens
  Payload ID: 6410
  Gene Symbol: FTCD
  Gene Name: formimidoyltransferase cyclodeaminase
  Uniprot ID: O95954
  ENST ID: ENST00000291670
  CDS Start-End: 45-1670
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatca

SEQ ID NO: 135135 - DNA, 1834 bp, Homo sapiens
  Payload ID: 6410
  Gene Symbol: FTCD
  Gene Name: formimidoyltransferase cyclodeaminase
  ENST ID: ENST00000397743
  CDS Start-End: 45-1532
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaa

SEQ ID NO: 135136 - DNA, 1878 bp, Homo sapiens
  Payload ID: 6410
  Gene Symbol: FTCD
  Gene Name: formimidoyltransferase cyclodeaminase
  Uniprot ID: O95954
  ENST ID: ENST00000397746
  CDS Start-End: 45-1670
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaa

SEQ ID NO: 135137 - DNA, 1955 bp, Homo sapiens
  Payload ID: 6410
  Gene Symbol: FTCD
  Gene Name: formimidoyltransferase cyclodeaminase
  Uniprot ID: O95954
  ENST ID: ENST00000397748
  CDS Start-End: 45-1763
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatca

SEQ ID NO: 135138 - DNA, 436 bp, Homo sapiens
  Payload ID: 6410
  Gene Symbol: FTCD
  Gene Name: formimidoyltransferase cyclodeaminase
  ENST ID: ENST00000446405
  CDS Start-End: 1-401
cgctgtggccggccctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggagggtaggtgggcaggcagcggggcatcgcctgggaatggaggcgctggcagggacagaaggcccctagtcccatgtgacctccagtaaagttttggcaccaaa

SEQ ID NO: 135139 - DNA, 1304 bp, Homo sapiens
  Payload ID: 6410
  Gene Symbol: FTCD
  Gene Name: formimidoyltransferase cyclodeaminase
  ENST ID: ENST00000625428
  CDS Start-End: 45-1304
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctg

SEQ ID NO: 135140 - DNA, 1304 bp, Homo sapiens; identical to SEQ ID NO: 135139
  Payload ID: 6410
  Gene Symbol: FTCD
  Gene Name: formimidoyltransferase cyclodeaminase
  ENST ID: ENST00000625846
  CDS Start-End: 45-1304

SEQ ID NO: 135141 - DNA, 1304 bp, Homo sapiens; identical to SEQ ID NO: 135139
  Payload ID: 6410
  Gene Symbol: FTCD
  Gene Name: formimidoyltransferase cyclodeaminase
  ENST ID: ENST00000629394
  CDS Start-End: 45-1304

SEQ ID NO: 135142 - DNA, 1304 bp, Homo sapiens; identical to SEQ ID NO: 135139
  Payload ID: 6410
  Gene Symbol: FTCD
  Gene Name: formimidoyltransferase cyclodeaminase
  ENST ID: ENST00000625714
  CDS Start-End: 45-1304

SEQ ID NO: 135143 - DNA, 944 bp, Homo sapiens
  Payload ID: 6411
  Gene Symbol: FTCDNL1
  Gene Name: formiminotransferase cyclodeaminase N-terminal like
  ENST ID: ENST00000416668
  CDS Start-End: 442-675
gcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttggtggacaagcgcaaccaagcctaaaggcaagtgctgttgcgaggtcgacatccaggaaccagaggagggcagagcaatccacagaatggatctggggtgactcatggaggaaaaccaacacacagtaccatttaattctttttaaaaagatggaaaattataccatacccagaattactaaattctaaatagagggtatattgcatttacatttgtaaaagaatgtttccccatgtatcttttaaaaattcattttaaagatatacaataaaaagtgtttaactctgtttttc

SEQ ID NO: 135144 - DNA, 772 bp, Homo sapiens
  Payload ID: 6411
  Gene Symbol: FTCDNL1
  Gene Name: formiminotransferase cyclodeaminase N-terminal like
  ENST ID: ENST00000420922
  CDS Start-End: 123-467
ctccacccaggaacctagtcggcaccgcgcagggaatcccagcagcggggttctggccccagcacgcgttgcggcagcctggcgagcgtccttgcggcctccaagtgccggtgggaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggcagttctgttctggctgcctgcctagaggccttccaggctatcgatatggaagttcaagagggaatccacccttgcctgggagcagtggacttgattccgatttaccctctctctggtgtcacagtggaatagtgtggagtggtggccagaatggacaagcgcaaccaagcctaaaggcaagtgctgttgcgaggtcgacatccaggaaccagaggagggcagagcaatccacagaatggatctggggtgactcatggaggaaaaccaacacacagtaccatttaattctttttaaaaagatggaaaattataccatacccagaattactaaattctaaatagagggtatattgcatttacatttgtaaaagaatgtttccccatgtatcttttaaaaattcattttaaagatatacaataaaaagtgtttaactctg

SEQ ID NO: 135145 - DNA, 1021 bp, Homo sapiens
  Payload ID: 6411
  Gene Symbol: FTCDNL1
  Gene Name: formiminotransferase cyclodeaminase N-terminal like
  ENST ID: ENST00000420128
  CDS Start-End: 412-828
gcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggccttgctgaggatctggtgctgcatgttcctggctgcagcgtgtttctctttggcgaagctgacctgcctgagaagcgcagtcttgtgcagagaaggaagcagctgggctggttcacgaggagggatttcagtgctcttcagcctgacctgggagctgccccttcccaaagatgtggtttaacagcttgcttcagggcgttgtgacagttgtgttggaagaaaattggaatttcagccttgcagtgaggggatccgtgctgccaccagagcagctgagtgccaatctgcgggaggcgggagtggagcgaaactgcaaactgagaaacaaactttcacatcaggtttctaattttagagcaaaaagtggaattactttaattatatgacatttaactag

SEQ ID NO: 135146 - DNA, 1997 bp, Homo sapiens
  Payload ID: 6411
  Gene Symbol: FTCDNL1
  Gene Name: formiminotransferase cyclodeaminase N-terminal like
  Uniprot ID: E5RQL4
  ENST ID: ENST00000622774
  CDS Start-End: 389-832
gacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggccttgctgaggatctggtgctgcatgttcctggctgcagcgtgtttctctttggcgaagctgacctgcctgagaagcgcagtcttgtgcagagaaggaagcagctgggctggttcacgaggagggatttcagtgctcttcagcctgacctgggagctgccccttcccaaagatgtggtttaacaggttctgagcatggtttttgctttgctctgttttttttttttttttaaacttgaggtcccctttatgagccacaccctgttaatgcaggaagagttataggggtggctgcttcttgaaatgggtgaggctctcctttctgctgttactctcacccaggcccttttaagctaacctgtgagcctagaagctcccgtcaagtatttgatgagggcccccagaagtgatattcaagatatatcattagccctgcaacgtgatcactgatgaaaagaatgctcgtagctcctggcactggggcagggtcctggaggcccctgtctgtgaatggtgtggggtgtgtcctagggtgtgatggagacacctggagagggaggacttagggagagatcacttctagctggtaggaaggtctttcaatacttaaacatcagtgtagccaagttggtgcttacagctggaaatcagttctagaggaaccctggaaaaaagctgttctagataacggacttctagaatgcagagaccaaagactggaaaaagaaactattccttcccctggcttttatcaacttttgcctctctgtgctgctcctgccctcactccctgccccaccctaagggatgtgtcaggaaaaggtggaactcctctctgttgtctgtacttccaccatcctagtgtcacttatttgagtcttaattgttccattttcagactctgttggggccacaaattaaaccatgtaaggtcacattttgatggtcagtcaataacttaagcagttaccaaaatactaggtatccaaggagcgagaggtgggcgagcataagaaacacatttctcatggcacagctctgccaaagccctgcagaatcatttacacataggtctttggttagtagcccctggcacagaattctgatcttaaacaaatattgtctataatcaagtagagcaatgcaattaaaaaaaaaaagcacaggttttggggccatgctgaaatcccagccttgctatttgctggctgtgtgaccgtggttccttggtctcattatgctttggttcccgtatctataaaacggacgtaataatgtctccctctcattattgtgaagtcgaaatgatgtctgtaaagtgcccaacacagtactaaagggctatttttttcttccctatgaagatgagatttaataaaagtgatattacaaatgtat

SEQ ID NO: 135147 - DNA, 3930 bp, Homo sapiens; identical to SEQ ID NO: 134851
  Payload ID: 6412
  Gene Symbol: FMN1
  Gene Name: formin 1
  Uniprot ID: Q68DA7
  ENST ID: ENST00000320930
  CDS Start-End: 468-2456

SEQ ID NO: 135148 - DNA, 12355 bp, Homo sapiens; identical to SEQ ID NO: 134853
  Payload ID: 6412
  Gene Symbol: FMN1
  Gene Name: formin 1
  Uniprot ID: Q68DA7
  ENST ID: ENST00000334528
  CDS Start-End: 1-3591

SEQ ID NO: 135149 - DNA, 4060 bp, Homo sapiens; identical to SEQ ID NO: 134859
  Payload ID: 6412
  Gene Symbol: FMN1
  Gene Name: formin 1
  Uniprot ID: Q68DA7
  ENST ID: ENST00000558197
  CDS Start-End: 279-1790

SEQ ID NO: 135150 - DNA, 393 bp, Homo sapiens; identical to SEQ ID NO: 134858
  Payload ID: 6412
  Gene Symbol: FMN1
  Gene Name: formin 1
  ENST ID: ENST00000559610
  CDS Start-End: 1-343

SEQ ID NO: 135151 - DNA, 699 bp, Homo sapiens; identical to SEQ ID NO: 134857
  Payload ID: 6412
  Gene Symbol: FMN1
  Gene Name: formin 1
  ENST ID: ENST00000560317
  CDS Start-End: 1-545

SEQ ID NO: 135152 - DNA, 4251 bp, Homo sapiens; identical to SEQ ID NO: 134852
  Payload ID: 6412
  Gene Symbol: FMN1
  Gene Name: formin 1
  ENST ID: ENST00000561249
  CDS Start-End: 127-4092

SEQ ID NO: 135153 - DNA, 576 bp, Homo sapiens; identical to SEQ ID NO: 134855
  Payload ID: 6412
  Gene Symbol: FMN1
  Gene Name: formin 1
  ENST ID: ENST00000558711
  CDS Start-End: 1-175

SEQ ID NO: 135154 - DNA, 4260 bp, Homo sapiens; identical to SEQ ID NO: 134854
  Payload ID: 6412
  Gene Symbol: FMN1
  Gene Name: formin 1
  Uniprot ID: Q68DA7
  ENST ID: ENST00000559047
  CDS Start-End: 1-4260

SEQ ID NO: 135155 - DNA, 13529 bp, Homo sapiens; identical to SEQ ID NO: 134856
  Payload ID: 6412
  Gene Symbol: FMN1
  Gene Name: formin 1
  Uniprot ID: Q68DA7
  ENST ID: ENST00000616417
  CDS Start-End: 505-4764

SEQ ID NO: 135156 - DNA, 6434 bp, Homo sapiens
  Payload ID: 6413
  Gene Symbol: FMN2
  Gene Name: formin 2
  Uniprot ID: Q9NZ56
  ENST ID: ENST00000319653
  CDS Start-End: 231-5399
gccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacagggcgaacgctgttggagaagctgttcagccagcaggagaacgggcctccagaagaagcagagaagttttgctcccggatcattgccatgggtcttctccttccttttagtgattgcttcagggaaccgtgtaatcagaatgcccagacgaatgcagcttcgtttgatcaagatcaactttatacctgggctgcagttagtcaacccacacactcattggactattcagaagggcagtttcctaggcgagttccatccatggggccaccatccaaacctcccgatgaggaacacaggctcgaggatgctgaaacagaatctcaatctgctgtttcagaaactccccaaaaacgctcagatgctgtccagaaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccacgaacactctgtttcctctgcctttaaaaacagctgtaacatcccatctccaccacctctgccttgcacagagtcctccagctccatgcctggcctgggcatggtgcctcccccacctccccctctccctggcatgacagtgcctactctgcccagtacagccattccccaacctcctcctctgcagggtacagaaatgctgccaccccctccccctcctcttcccggagcgggcatacctcctccgccgcctctacccggagcaggcatactccctctgccccctctacccggagcgggaatacctcctccgccccctctacccggagcggcaataccccctccgccccctcttcccggggcaggcataccccttcctccccctcttcccggagcaggaatacctcctccaccccctctacccggagcgggcataccccctcctcccccacttcccggagcgggcataccccctccgcccccacttcccggagcgggcataccccctcctccccctcttcccggagcgggcatacctcctccaccccctctacccggagcgggcataccccctccgcccccacttcccggagcgggcataccccctccgcccccacttcccggagcgggcataccccctcctccccctcttcccggagcgggcatacctcctccaccccctctacccggagcgggcataccccctccgcccccacttcccggagcgggcatacccccacctccccctctacccggagcgggcataccccctccgccccctctacccggagtgggcatacctcctccgccccctctacccggagcgggcataccccctcctccccctctacccggagcgggcataccccctcctccccctcttcccggagcgggcatacctcctccaccccctctacccagagtgggcataccccctccgcccccacttcccggagcgggcatacccccacctccccctctacccggagcgggcataccccctccgccccctctacctggagtgggaatacctcctccgccccctctacctggagtgggaatacctcctccgccccctctacctggtgctgggattcccccacctcctcccttgccaggtatggggattccacctgctccagctcccccactccctccacctgggacaggaatcccaccgccccctctgcttcctgtatcaggccctccactcctcccacaagttgggagtagcactttaccaaccccacaggtgtgtggatttcttcctcctccattgccaagtggcttgtttggattagggatgaatcaggacaaagggagtaggaagcagcccatagagccttgtcgaccaatgaagcctctttactggaccaggattcaactacatagtaaaagagactccagtacttcacttatttgggaaaaaattgaagagccatccatagattgtcatgaatttgaggaattattttctaaaactgctgtaaaggagagaaagaaacctatctctgatactatctcaaagacgaaggctaaacaagttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaaga

SEQ ID NO: 135157 - DNA, 602 bp, Homo sapiens
  Payload ID: 6413
  Gene Symbol: FMN2
  Gene Name: formin 2
  ENST ID: ENST00000441342
  CDS Start-End: 304-602
gttaaaaggggactgacaggatgaaggcagtacagaatgctgggctgagagcaggactgagatcctagaggcagaatcccagtctacccgtactctctgggaggaagtgatgagaacttgcagcagggtggtggtagtgaaagagaagaatgaaagacaaggaagcatcagtggaacttgatgtgtggctggataccagaaatgcagaggaagttagtcaaaggttcccgtcctgatgactggagatcatggtatcactgactgagctctaggggttgtgaaatagagctcattaggcagaggatggttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcat

SEQ ID NO: 135158 - DNA, 906 bp, Homo sapiens
  Payload ID: 6413
  Gene Symbol: FMN2
  Gene Name: formin 2
  ENST ID: ENST00000447095
  CDS Start-End: 221-906
atcgccagaatggctgaacccaggcgctttctacggctctctttcctcttggtcagctccaagtatgagatttatgaacgttgaagaggttcattgattcaccattgtggtacaggatgttgacagcaaagaagggcgaacgctgttggagaagctgttcagccagcaggagaacgggcctccagaagaagcagagaagttttgctcccggatcattgccatgggtcttctccttccttttagtgattgcttcagggaaccgtgtaatcagaatgcccagacgaatgcagcttcgtttgatcaagatcaactttatacctgggctgcagttagtcaacccacacactcattggactattcagaagggcagtttcctaggcgagttccatccatggggccaccatccaaacctcccgatgaggaacacaggctcgaggatgctgaaacagaggatgatggagaatctcaatctgctgtttcagaaactccccaaaaacgctcagatgctgtccagaaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaag

SEQ ID NO: 135159 - DNA, 1913 bp, Homo sapiens
  Payload ID: 6413
  Gene Symbol: FMN2
  Gene Name: formin 2
  ENST ID: ENST00000545751
  CDS Start-End: 288-884
caagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgc

SEQ ID NO: 135160 - DNA, 2902 bp, Homo sapiens
  Payload ID: 6413
  Gene Symbol: FMN2
  Gene Name: formin 2
  ENST ID: ENST00000543681
  CDS Start-End: 2661-2789
attcctgccctggtggagcttacattatagaagggaggtccagaccatcaataaatatacagcgaagctccaaggaaaaacagagcagggcaaagagaagacagctatgggaggtggtttattttatataaattagccagacagtgcctctgagaggtgatgtctaagcagggactcggagatgagggaataagctaatggatatctgaagaaagaaccttccacatggatgaagcatcgcatgcaaagctcaaggaaggagcatgtttagtcaagtgcctaaagtggctggagcagagtgagtgagagttgagaggtagaagatgaattcggagagggagcattggggccagactatgtagcctagtgggccaagtgaggtcaggcctttaagaaggagcgtattgaggaagaaccatgcacactactgctagtgctagggtgagaaagatgaggactgagaactgacctggatttgggatcttgggtgaatgagtgacatccgcaagagtagtctctgttgactggttagggacagatgtctgattaactgggagcacaggaagctggggcagtgactctaggtaacacgctcttgaggcattggtatatgtaaagggtcacaatggaaaggaaagctagcaggagggcaagggaattagggttttgtttttgtgtttatttttggtgctgggataaacagcgtatgtgtcactgggtagaaatgatccagtaaaggaaaaattgtgaactttgttctctcttaatatgtgtgtttcgttgattcattcctgacttgtatctcccacatcttatcccttaattaagccattcttcctcttgcataattgcaaattattatgatataaatagctttgttgtactcttttatgagttttacagggaggaaattgcataaactctctataaagtaatttctatgtttaaaagcccttaagttctcccgccccatagcctgaccaaaaaagtcttactaaacaaaaataggatacaaatgatccatacacatcatcctggctagagaagggtcagaaactacagtgttgttagaaccaatagagcttaactttatatctcactggctttaataaaaaacttttctgagctatttgacacaaaaatcactaagattaagaaaatatcttaacacaggtggaaatagtaaaaggatgtttgcatgaaaaccgtcaaatgtaataaacagcactattctctgataataaaagatgaatctggctgtcagatgcaattttataatagcttcgaccatcatgtacggcaggagtatttttttttatttactatcgttaagtttgtggaaccagtgattgttgttttactattttgttaaggaaacctaaaacattcttagaatgtacagaaagaatatggtcattcttataggaccaaagggcgtatcaagtgagctgcttttgtaaataccatgaaaatccaagtctgacatggaattaaaatcatctctactacaagatgcagaaaaaaaccaaactcttttttttctatatcagagacttaaaaatattagtgatgaccaatgtgattagaagctttaaaatcctaacatttatgtgaacaaaaatcttcctgttttcagagacttaagcatatcatctgagcattgaaaaaagctcttaatagtacctttcagatttctcatctgttttcagatcccatattaaactccttgtggaagaatgagaaagaaagctactctaaattttacagaatagaattcaggctctttatttacaaaatggagtgtgaaccttgctgtttactcatctaccccctcaagcaattgtgttttccttccttatcagcacagaccatcacagttccaggatttgtctgagatgctagccacctctgattgctattcactggacactcttgtgattgtgatttaagattgtaggccaggcatgagccaccgcgcccagccggcatgtaaatttttatgtgacactttttttttggtggggggtggcaggggagagggtctcactgttgcccaggctagagtgcagaggtgctgatcacagctcactgcagggcacgcaccaccatgcccggctaagtttttgtattttttgtggagtcagggtctcactctgttgcccatgctggtctggaactcctgggctcaagcaattcacccgccttggcatcccaaagtgctgggattgcaggcatgagctactccgccctggctgtgatactctttaattattctaatgcttctaacttacgtcatggtgccaatcctatttatataatagaatcaatctcatactctcagctgacaatgaggggtatttcattttttacttgtatataagattccttttatataggatgaaatgcatacacactctgcatagaaattcttatgtgtttgtatattactccattcaatcatactatgattccaagttaagaactcctagataaattagcgtctgtagctgtaacagttgaggctttcaattcaaatgtcagataacattcttctgtgtattgtattattttctgcagtaattcaaatctttattgagttgaggtttgctcacttactataaggtagaatgaggtgatctaagtaggttttgtttaaatacatgtgtcttctccccatcagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctct

SEQ ID NO: 135161 - DNA, 1977 bp, Homo sapiens
  Payload ID: 6414
  Gene Symbol: FNBP1
  Gene Name: formin binding protein 1
  Uniprot ID: Q96RU3
  ENST ID: ENST00000355681
  CDS Start-End: 193-1971
attttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagtctcccaagcagcaaaaggaacccctctcccatcgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccat

SEQ ID NO: 135162 - DNA, 5227 bp, Homo sapiens
  Payload ID: 6414
  Gene Symbol: FNBP1
  Gene Name: formin binding protein 1
  ENST ID: ENST00000443566
  CDS Start-End: 220-1875
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 135163 - DNA, 5410 bp, Homo sapiens
  Payload ID: 6414
  Gene Symbol: FNBP1
  Gene Name: formin binding protein 1
  Uniprot ID: Q96RU3
  ENST ID: ENST00000420781
  CDS Start-End: 220-2058
cggccgcggctgctgcttcctcgggccattttgctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 135164 - DNA, 5393 bp, Homo sapiens
  Payload ID: 6414
  Gene Symbol: FNBP1
  Gene Name: formin binding protein 1
  Uniprot ID: Q96RU3
  ENST ID: ENST00000446176
  CDS Start-End: 188-2041
gctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggctttctctcaagctgggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 135165 - DNA, 2256 bp, Homo sapiens
  Payload ID: 6414
  Gene Symbol: FNBP1
  Gene Name: formin binding protein 1
  ENST ID: ENST00000449089
  CDS Start-End: 1-1706
aactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggcccgacaacaagctcaaatacgtcaccaaatggcagaggacagcaaagcagattactcatccattctccagaaattcaaccatgagcagcatgaatattaccatactcacatccccaacatcttccagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtgggggtgcaacaccggaggatttcagcaacctcccacctgaacaaagaaggaaaaagctgcagcagaaagtcgatgagttaaataaagaaattcagaaggagatggatcaaagagatgccataacaaaaatgaaagatgtctacctaaagaatcctcagatgggagacccagccagtttggatcacaaattagcagaagtcagccaaaatatagagaaactgcgagtagagacccagaaatttgaggcctggctggctgaggttgaaggccggctcccagcacgcagcgagcaggcgcgccggcagagcggactgtacgacagccagaacccacccacagtcaacaactgcgcccaggaccgtgagagcccagatggcagttacacagaggagcagagtcaggagagtgagatgaaggtgctggccacggattttgacgacgagtttgatgatgaggagcccctccctgccatagggacgtgcaaagctctctacacatttgaaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccatgactgttacaggcagttcctcaagagactggctggcaagcaccataatgcacgttctcctgtagtctcacgtggacttcagggtctgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggc

SEQ ID NO: 135166 - DNA, 5341 bp, Homo sapiens
  Payload ID: 6415
  Gene Symbol: FNBP1L
  Gene Name: formin binding protein 1-like
  Uniprot ID: Q5T0N5
  ENST ID: ENST00000260506
  CDS Start-End: 152-1807
tcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgtt

SEQ ID NO: 135167 - DNA, 4212 bp, Homo sapiens
  Payload ID: 6415
  Gene Symbol: FNBP1L
  Gene Name: formin binding protein 1-like
  Uniprot ID: Q5T0N5
  ENST ID: ENST00000271234
  CDS Start-End: 152-1969
tcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggtggtcggtgaagatgggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgtt

SEQ ID NO: 135168 - DNA, 3889 bp, Homo sapiens
  Payload ID: 6415
  Gene Symbol: FNBP1L
  Gene Name: formin binding protein 1-like
  Uniprot ID: Q5T0N5
  ENST ID: ENST00000370253
  CDS Start-End: 1-1644
atgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaa

SEQ ID NO: 135169 - DNA, 1518 bp, Homo sapiens
  Payload ID: 6415
  Gene Symbol: FNBP1L
  Gene Name: formin binding protein 1-like
  ENST ID: ENST00000424449
  CDS Start-End: 1-1355
aaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggtggtcggtgaagatgggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccat

SEQ ID NO: 135170 - DNA, 1830 bp, Homo sapiens
  Payload ID: 6415
  Gene Symbol: FNBP1L
  Gene Name: formin binding protein 1-like
  ENST ID: ENST00000604705
  CDS Start-End: 1-1830
atgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggtggtcggtgaagatgggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaa

SEQ ID NO: 135171 - DNA, 3972 bp, Homo sapiens
  Payload ID: 6416
  Gene Symbol: FNBP4
  Gene Name: formin binding protein 4
  Uniprot ID: Q8N3X1
  ENST ID: ENST00000263773
  CDS Start-End: 14-3067
gcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataatcctga

SEQ ID NO: 135172 - DNA, 582 bp, Homo sapiens
  Payload ID: 6416
  Gene Symbol: FNBP4
  Gene Name: formin binding protein 4
  ENST ID: ENST00000540172
  CDS Start-End: 154-582
gtgctccgctggttgaaagcggatccgggctggaggcggtgtcacggtgtatgaatattgattacgcgtcgcagcgcccagggcccagcgcccagcctccagtgcccgcccctctcggccgcccgacgctctctgctcgcgcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggagatcgatgccataacagctcctcagcctgcagctcctgtaggagcttctgctccacctccaactccacctcgaccagagccaaaggaagcagcaacatctaccctttcttcttc

SEQ ID NO: 135173 - DNA, 3990 bp, Homo sapiens
  Payload ID: 6417
  Gene Symbol: FHOD1
  Gene Name: formin homology 2 domain containing 1
  Uniprot ID: Q9Y613
  ENST ID: ENST00000258201
  CDS Start-End: 249-3743
cgggattcccattgggccctgtgagtggctagcggcggccccgcctccggcagtggttacctcctggcgcgcactcggggactaatcttggctccacccccttcctcggccccgcctccgtctggccccgcccctccagccgcgtccggtccggccgggcccgaaccgcggagctacagtgtgctttgagtagaagctgcactggggccgggactcggaggcgcgctgcgtgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgagctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 135174 - DNA, 2069 bp, Homo sapiens
  Payload ID: 6417
  Gene Symbol: FHOD1
  Gene Name: formin homology 2 domain containing 1
  ENST ID: ENST00000561922
  CDS Start-End: 69-542
gtgctttgagtagaagctgcactggggccgggactcggaggcgcgctgcgtgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggggttttataccctaccttttgcagaaaagctgtatagctccagtggtcctgagctccgccgctccctcttctcactgaagcagatcttccagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctgggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgagctgaagctggctgggggccatggagtctctgcaagccgctttgggccctgcgccaccctctgggcttcactggaccctgtctcagtggacacggcccgactggaacacctctttgagtctcgt

SEQ ID NO: 135175 - DNA, 773 bp, Homo sapiens
  Payload ID: 6417
  Gene Symbol: FHOD1
  Gene Name: formin homology 2 domain containing 1
  ENST ID: ENST00000567561
  CDS Start-End: 1-68
tcagcaaggatggcattgagatgactgaggggtcaagaccaatgcctcaggcctcaggcctgcattgagggggccatgtcaggctctggctacatcctcagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccgggga

SEQ ID NO: 135176 - DNA, 563 bp, Homo sapiens
  Payload ID: 6417
  Gene Symbol: FHOD1
  Gene Name: formin homology 2 domain containing 1
  ENST ID: ENST00000567509
  CDS Start-End: 1-327
gggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgaggctctggctacatcctcagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggca

SEQ ID NO: 135177 - DNA, 520 bp, Homo sapiens
  Payload ID: 6417
  Gene Symbol: FHOD1
  Gene Name: formin homology 2 domain containing 1
  ENST ID: ENST00000568595
  CDS Start-End: 1-85
ttttcctaccatctctgtggcaccctcagctgacacctccagcgagaggagcatctacaaacttcaccaaactgcttccgtttgagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccct

SEQ ID NO: 135178 - DNA, 4967 bp, Homo sapiens
  Payload ID: 6418
  Gene Symbol: FHOD3
  Gene Name: formin homology 2 domain containing 3
  Uniprot ID: Q2V2M9
  ENST ID: ENST00000257209
  CDS Start-End: 123-4442
agcctgcgagtccgcgagccagcgagctgcggctgcggcctcccctgcgcgcagctacccgggcgtcccggcccgcggccccgctaaccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 135179 - DNA, 4518 bp, Homo sapiens
  Payload ID: 6418
  Gene Symbol: FHOD3
  Gene Name: formin homology 2 domain containing 3
  Uniprot ID: Q2V2M9
  ENST ID: ENST00000359247
  CDS Start-End: 1-4269
atggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggttta

SEQ ID NO: 135180 - DNA, 1720 bp, Homo sapiens
  Payload ID: 6418
  Gene Symbol: FHOD3
  Gene Name: formin homology 2 domain containing 3
  ENST ID: ENST00000585579
  CDS Start-End: 1-1127
acgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatgatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 135181 - DNA, 4869 bp, Homo sapiens
  Payload ID: 6418
  Gene Symbol: FHOD3
  Gene Name: formin homology 2 domain containing 3
  Uniprot ID: Q2V2M9
  ENST ID: ENST00000590592
  CDS Start-End: 1-4869
atggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggcggggcaagaagcacagcatcatcctaaggacgcagctgtctgtgagggtccatgcctgcatcgaaaaactatacaactccagcggacgagatttgagaagggccctcttctccctgaagcagatatttcaggatgacaaggatttggtgcatgaatttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaggaggaggaggaggaagaggagcagccaatcacggagcccagttccgaagaagagagagaggatgatgcttcctgtcagggcaaggacagcaaggtcggcgctgcctcagggcagagccccactggaagggatgctgctcccaagagctctgccctccctgctgtctcgaatgccagctcgcagggaaagccgcttctggttggcactgcaggcgggaccacctggcacagtgggtcctctgggtctgaggccaccccatctgccctcctgtcaccccctgcctcagctgctcggccctcctccgccacaccaggctccctgaaggtgtcaccgaccatagacaagctgccctacgtgccccacagccccttccacctcttctcctatgactttgaggactcctccctgtccaccaaggagaaggaagcagagtcccagaaggaaaacagttcctctgattctttctctttgagcacatattctgcctctgagccttaccacttccgatctttctcttctaatagatacagcaattttggcaataactcttatcactcctcaagaccctcatctggatccagtgtgcccaccacccccacatcatccgtctcacccccacaggaggccaggttggaaaggtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatactgatgaggaggaggaagttgagtctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtga

SEQ ID NO: 135182 - DNA, 3035 bp, Homo sapiens
  Payload ID: 6418
  Gene Symbol: FHOD3
  Gene Name: formin homology 2 domain containing 3
  ENST ID: ENST00000591635
  CDS Start-End: 603-2510
agtcggctccctcactgcctctggacttgccaaagttttgttgaggtggagaggtcgccacaggctgaaagcattaaggagaaccaccctggcatgcggagcagtcggtgtgctttggaggaaaacatacaaaccagctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaaatacagcaattttggcaataactcttatcactcctcaagaccctcatctggatccagtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 135183 - DNA, 2112 bp, Homo sapiens
  Payload ID: 6418
  Gene Symbol: FHOD3
  Gene Name: formin homology 2 domain containing 3
  ENST ID: ENST00000592128
  CDS Start-End: 1-1587
cgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 135184 - DNA, 4126 bp, Homo sapiens
  Payload ID: 6418
  Gene Symbol: FHOD3
  Gene Name: formin homology 2 domain containing 3
  ENST ID: ENST00000592930
  CDS Start-End: 1-3601
gttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgcc

SEQ ID NO: 135185 - DNA, 2330 bp, Homo sapiens
  Payload ID: 6419
  Gene Symbol: FMNL1
  Gene Name: formin-like 1
  ENST ID: ENST00000328118
  CDS Start-End: 49-1929
ctggatttccgaggctggaggcgcctggccggctgggtggggaccaccatgggcaacgcggccggcagcgccgagcagcccgcgggccccgccgcgccgccccccaagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggctgtgcccacaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacc

SEQ ID NO: 135186 - DNA, 4101 bp, Homo sapiens
  Payload ID: 6419
  Gene Symbol: FMNL1
  Gene Name: formin-like 1
  Uniprot ID: O95466
  ENST ID: ENST00000331495
  CDS Start-End: 337-3639
gagcgacagcagaagttcgaaaatcgccgaggggggagccagcgccgcagcttcctgcccccggcccagccctctggccccggcggcctgcagcctgacttcctcccccaaccctgcagctcgccgcccggtcccacggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgggagctcatctgtgatcaggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaaga

SEQ ID NO: 135187 - DNA, 1475 bp, Homo sapiens
  Payload ID: 6419
  Gene Symbol: FMNL1
  Gene Name: formin-like 1
  ENST ID: ENST00000586643
  CDS Start-End: 1-1467
gagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcag

SEQ ID NO: 135188 - DNA, 2487 bp, Homo sapiens
  Payload ID: 6419
  Gene Symbol: FMNL1
  Gene Name: formin-like 1
  ENST ID: ENST00000587489
  CDS Start-End: 91-2139
ggcggtgccagtgccgggctgcgggtcggggctcaccatgtgctggtgctacagctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaa

SEQ ID NO: 135189 - DNA, 769 bp, Homo sapiens
  Payload ID: 6419
  Gene Symbol: FMNL1
  Gene Name: formin-like 1
  ENST ID: ENST00000589911
  CDS Start-End: 1-384
gtgcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaaggtaggcaactgctcctgggcttggtactgggctgcagggatgcatggcatctcatcaccctctggtgccacccccacaccctcactgttacagactgaccctgccccaggagcctgggatgggaaagggttctttctgctcaagccagctgtccttgctgtgggggaccaggcagatattccagggttttggtgatggggaggcatcctggagctggagctataaattccccctagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccg

SEQ ID NO: 135190 - DNA, 453 bp, Homo sapiens
  Payload ID: 6419
  Gene Symbol: FMNL1
  Gene Name: formin-like 1
  ENST ID: ENST00000586092
  CDS Start-End: 1-453
gcggcaggatgactgcatggtgctcaaggagttcctgagggccaactcgcccaccatggacaagctgctggcagacagcaagacggctcagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctac

SEQ ID NO: 135191 - DNA, 5575 bp, Homo sapiens
  Payload ID: 6420
  Gene Symbol: FMNL2
  Gene Name: formin-like 2
  Uniprot ID: Q96PY5
  ENST ID: ENST00000288670
  CDS Start-End: 368-3646
gcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaatgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccgcctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactattctgtaa

SEQ ID NO: 135192 - DNA, 3648 bp, Homo sapiens
  Payload ID: 6420
  Gene Symbol: FMNL2
  Gene Name: formin-like 2
  ENST ID: ENST00000475377
  CDS Start-End: 201-1586
caccgccccctccgcctcctcctctcccaggccctgcagctgagactgtaccagctcctcccttagcacctccccttccctctgcacctccgctgcctggaacatcttcacccacagtggttttcaactcaggattagcagatgggccaatcaagcttttctctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagtgctgaagactgtgccctttactgctcgcaccgccaagcgtggctctcggtttttctgcgaacctgttctcactgaggaataccattactaaactattactctttctcacctgatgctcttaaaagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacacta

SEQ ID NO: 135193 - DNA, 12634 bp, Homo sapiens
  Payload ID: 6421
  Gene Symbol: FMNL3
  Gene Name: formin-like 3
  Uniprot ID: Q8IVF7
  ENST ID: ENST00000335154
  CDS Start-End: 235-3318
gagccggccgcctccgtccgccttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaggcctgactttgtctcctctttctgagcttagggggctagggtggccatttagtctgacctgggctatggggatagaaaagaaatctttggggcactgcatctgttttggaggagatgagatcagaactctggggaaaggagaaccggctaggtgggctctagccacacaaagggaagcaggcctgccatgagacactagtgccctctgctgggcatgtgtccagtccccagcctgccccagtagcacatggaaaagagtcactggccatgttataaatattgttatttaaaaaacaaaaaacaaaacacacgtacattaggtcctgggtggaggaagaagtggtggagcctcagggccagggcaggcaggagcaggcactgatgctagagggtgatgaccctgccctctgccacccaggctgcgtccaacagcctgtgactcttccctggagaccccttctctcacacttttatctactggcatcacccaccccacatggcatataccacccatctctggtctggggctgagggcaaggactgcactagtccagggagtaggggacccttgaacaccaagagcaaccttgagaggtgccaacaatggtgtgctgggggtggggttactttagaaaaagtggacacagaccagactaaggaagaagtctgaggcagacggtgagggtggcccaggagccatggcctcacacagacccgaggcagagaacagctcattgggtcactggtgatcatccagctgctgtaggagtgtccgccgccgcctctccagctcaccctcactcagctcactttctgacgtgtcccagcctgtctgttggagcaaaggcacagttcacccttagcctgcactaagggccgtggaagcttgaccagcgtgctgactggcctagggcccctgcccctcaccttctccttcttgattccaaagcctggggaacggttagggagctctgcctgttggagctccctgtccttgtcctgttcttgttctttctcatcgctctccttgccagctttctcctcagggtctgtctcactctcaggactattctgtaagagtccagagcccacctcctcagttcctgtggatagcctgggaggcaggtagaacagaactcacaaaatagcaggggcttaggtagaagttccttcactcaccgacttgtgtcttctcttcttagttttcttttttggtttcttggctttccgaaggccatgatctagagatagaaaaatccctactaagtcccaacaggagaaagacaggctctttttctttgttctagcccctctgttcattcttcacaggcaggaacctcatgctctgaggaagtctaagtccagttttccttctccagcttcttgcttgggcaggtagaggaagttctttctacttccacaggtgcagccctcccaatccagtctaccctcaaaggagctggggcttgtggagggcatcctctcagtctgggacaacagttctccagcttctacgctcacagcaactgcttacctgctccaagaagatgggaggaaggggagccccgtcctccaagggcagcacccccactttcaactgaatcaagtgaggaagagggctcagagcctgactctgaggggttccgcctcctccgcttggggggccggagagatggtgggggcagctcctcttcttctgactcagagccctgggcagatcagcagatacatgtcagtgcagaggttctctgccctccagaagccctcgtctgggaattcgagagaggaggaggacccagggccaaaggaatcctcaaacttccctccaagggagatattgtaaggggaaaacaaagtgtttatttccccaaaacaacccagcttcaccccatgtcccttctacacgcttactcactgagggtgagtgggaacgcttgtgatggtgcttcttgcctttcctgccatgctttcggcctttggtgtggaggtgctggcattcagtctgctagaggcagaggaagaagggtgaggacagcaccagacttagccccaggaaggatcctacttcctaaaatctggctttgcctccctttctcagactagagccttctgcctatcccagggatcctcaggcctccccttccttagctggccaggagtgccctaagggtaagagggaggccactgaggtctctgttgaactggtctaatgagttcaagggcctgaggcagatccagaggacaagcctgcctcacctccagcacctgtaggaactcccggaagagccggatccgctccgactccagggtgatctgctcaaaggctgagtcacacacaaaacgctcacggaccttgaacgaggagagcactgctgatcagactaggccccactcagcctggcctggacaccgccatgagcacagggcagggctggggcagagaaaggaagggaactggagctggcccagggctgtgacgtgactggggtgggccctcagtggtgaagcaccgctgccctcaggcttgaggggtgcttggggccaggctacgctcctgacctcttcccaggcagtgcctagctccagagcaggcacagcctgcctcagcatgcttcgaaaggcagcttccctgcgccgcatcctgcgtgcctcctccttctcccgctccctctcccgtgcctctgctttctccagcagctgaggaaagaagggacacggaacagggtcacccaggagggtggatgccaggtcccactcaggcataccttaggaggtggaaagttagggtctgggcttctaccaccatcccctgaattgggaatatagtcagtgggacagtgagtgagaaggaatggagcaagacacagatgaattagagaacttcccacgccccgcccagcccctcacactattgaaggtcagcttgatgttgcctgcgtccagtgcggcagccctcttgtcaaagcttatgacgtgggcgaagtcctcaaaggccgtgttcacctccacgcagaagccccggtcctgtgggtacagcagtgcatgaagcaggggcaccacgtgcctgaggccaaagctggcaggcagagtggtcacattacagatggtcaagaaggcccttgcctctggaagagatccacaggactgtggtctgcattagaaaccaagttatccaagtcctcatcacttgacaattaagcccccatgcctacccttggtttggatgtcacacagagctgaaggggttgggagatgtctcccaactgctgattaatgctgagtttctcaaaattaacttttgttcctttggcttaaagctctggccccagctgggccctcctgctgctcagcagtgcttccatgcattctcaatcaacatttgctggcccctaccctttgggtctatttattgagtgcttactatgtaccaggtaccatgatgagtgtttcacacattatctcatttaatcctcttggttctacatttaagaataggtcctagtatcctaattttacacagaaggagaaaccaaggttcagagaaactagagcacttgcccaaggtctcacagctgatatacggctgggcaagaaccctaccctgggggggctctctatccccaaagtgtctgctttcaagcaccacacccacccagatgacttagtccatgggagaaacggaggccaccaggtgtgcagctccccaccaatactaaaaacatgtccacaggccaggctctatgcttctcatttaggcctcacaacattccagtgaagcagaggcttagaaaagtgatctcagttggcccaagatgacatgagtggtaaatgaagccactggagttcaaagtctggctctcacgtcagttaagcacaggccagattccctttctctccctccacatagctctcacctcctctggcctttttgctgatggcagaggtgtgctcctctttcttctttccaagggtacttcctcaaccctgctacagtccttatcaacacagcattcattctcagggaattgaaagctccaagtcacccttgttactggctccttccatcaagcagacacctcacctaacctggaacatcctttccaccatgctctccccttcatcaagctaactacctctgctcttttccattgtttcaaaacctcttgaaatgcagcagaaaggaaaaggaataaacatttattgagaacctattagacactttacagatgttatttaattctcacaaccttacctatgaattatccctgatttacaggtgagcaaacaggctcagagacacggaacttacggaggtctcagagccaataagcaaccaggagtaatctgactctaaaacatgtgctgcccccatgccacctccatgactctactctcccaaaggttgcttgtgtctactagccaaatccaaggccgccttctttgtcctcactcatctggtcctcagtgcctctaccacttacttcttcaacactcccctctccaggtcacaccctctctgaccttttattctcttgcatatgcatgttcctgagaacagcacttagtcctctttcactacccaatctgtactccctcgcaatctcatccttcatctctcctgattttcaaacatcctagactggatatttcagacacttaaaattcaacagatctcaagagaatatatttctcatgagcatcctccatggatctccctgacccggatctgtctgcctgttctaagtccagggctctttgcattatcctatgggatgaaaggcaccatcatggtctgcctggctgtggaaagcaagagggactcctgggctcatctgccctccataggcaggaacccaaatggggaaagaggaagggaactgtctaaaaaagttgctttctcaggttgtgtggagagacaggactcagtgaggataggcccctacaggcctatcaaccagccactctgtggctaaaagttaattgtccaataaaatttagctatcccaggataaggcatttctactttatacgattattctgttttaaaatatatttgctttgagagtaattccccaaatagaattcctattttctacagccttgctcttcttgttttatccttatcaatagtgccatcatccactgccctgacacctctgattccttcctttccctccatttcacaaaatctatcaattctacttagtgactctatcccactggtgttgaattctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtagccccaacagtaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatggtaagtaatttaaaatattaaatttatattaaataggtaatatggtgttaaaatgcaacacctacgtgaatttgtaaggcaaaacagtacttcaaagaaatgtatatgcagtgagacatttctagctttatttccagatccctttcaacccaggtaccatttaatctctgtaattaggtgtactctggtggaacactcaccattttttagatgaggaaacagggtcagaaaggtcaagtgacctatccaaggtcacacaactagcaagcagttaagctagacttttactgtaggcagtctgcctccagtcccgctcctaaccactgtactgtattatctcctcaaatgcattagaatcttcacttccataaagaaatatgctctttgtttttttcttttggaacacaaggtttagtccatcactcactcacttttccacttttgataagatgtaaatattgagaactatttctcttctccagtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtagatatctgctgaaccaagctgtaatgcttctgcaaaacaggacttatcagggagtcctctgcagggagtgtgccctgcatccatcctgtatccatccataaccccagcctccctcaccttaaggatgtccttaatgatcttcttttcatcatggaatcgtgccttcaactcctccacatagaacttgaataagtccagaggggtggagcctgtaaggagggagggaggggggcctggcgggcggcagcttcccaaggcctgggggctgggccgaggacaggagccggtagtagggggtgcagagaggctggcagggcaggaagccaggccagagaagggggagcctggctgccttacccggctggcccagcatgttggcaaagcggacatcagtgctgactgctggatatagctccatccaggtggacatagagtgcagctgccctgtctcatgcagctcgtccaggaaggtctgagcagggagaggccagttatagggagagtgagacagggaggcagagccacagactgagggggaagagagggaatggcagaggaagaggcagggacaatcaagattgaggaaatgcaggcaagagaggcagagatgaagagatgcagatggaaggctgagaacaatgcaaaaagagagaaagtaaatacacagagagggacagaacaaaaaggtgagaacaagccagtcccgggatgcaaagaaacagaaacctgcctgcagtaacccctagcactaccaccaccactgccacccccaagctgagggaataaactctgcctgtcgggtgccccaccaagggaaataaacatggcctagctgccaagtcatgcctgtagggtgctctctactggcagtttctgggtggtgcatacatctagtctccctagaagagcacagtccagaattgaggaggtacagcagaaacagactgcaggcagagagaggtctcatagagcttggacagggctaggcacagaaagaacaggcagcgtatccagaagggggcagggaatgggtgaagaggttgtgctctagggcagagctgagctctgatctagaaaggacagcaaagatacctggaaggcctcccgattcttgcgttgttggcgtcgctcccgaagccgggcccgctcccgttcctcctcctcttccctctccaaagctcggatgtgctcctcaaaacagatcagtgcatcttccttgtccatgtctaaagacaggcaggaggttccgcgggcattgtcccagcaggataccctctcagaccccagcacccctaatgtttcaacgatgctgtcctacaggtgctagggatacccagggtggtgggggaagggcctggagggggctctgtgggagcagccactgcaatggtagttcttaagaggggatcattaattgtataagaataaataagcaagtattca

SEQ ID NO: 135194 - DNA, 4006 bp, Homo sapiens
  Payload ID: 6421
  Gene Symbol: FMNL3
  Gene Name: formin-like 3
  Uniprot ID: Q8IVF7
  ENST ID: ENST00000352151
  CDS Start-End: 214-3144
cttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctc

SEQ ID NO: 135195 - DNA, 4120 bp, Homo sapiens
  Payload ID: 6421
  Gene Symbol: FMNL3
  Gene Name: formin-like 3
  ENST ID: ENST00000550488
  CDS Start-End: 41-3124
ggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccagg

SEQ ID NO: 135196 - DNA, 547 bp, Homo sapiens
  Payload ID: 6421
  Gene Symbol: FMNL3
  Gene Name: formin-like 3
  ENST ID: ENST00000550424
  CDS Start-End: 382-547
actggaagaagatggcggctagacaacaaatttccaccgcaaatgtcaacgacccagccgccgactgagcccagaacagcgttcttctcccgcctctccattttcacacgcagccagatggttaagcttctctcctcccaaacgttttttcccctgcctctgtcgggtaagggcttcctcatccctcaatgcctggtccaactatgatctccctcaccccgactcttaacagacccacttaccacaagccatcatcatagctatatataaagatctgggggatgagttttctaggaagagaacaacttttgcaaagccctggggtggaaaagaactttgcacatttgaggaactgcaagaaggccagactggtctacaaggatgctgaggagagtccgagaaggtataggaaagagctccatgaacctgcctccagacaaggcccggctcctgcggcagtatgacaatgagaagaaatgggatctgatctgtgaccaggaacgattccaggtgaagaatcctccccacacttacattcagaaactcc

SEQ ID NO: 135197 - DNA, 1930 bp, Homo sapiens
  Payload ID: 6422
  Gene Symbol: FPR1
  Gene Name: formyl peptide receptor 1
  Uniprot ID: P21462
  ENST ID: ENST00000304748
  CDS Start-End: 108-1160
atgttttgctgcaatcattagagcctgagtcactctccccaggagacccagacctagaactacccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttattattgacttcttttttgattttggacctcagccttgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccaggggtcaggaattcgagaacagcctggccaacatggtgaaaccctgtctctactaaaaatacaaaaattagctgggcgtagtggcaggctcccgtaatcccagctactcaggagaccgaggcaggagaatcgcttgaacctggaaggcggaggttgtagtgagccaagaaaacgccactacactccagcctgggtgacagagagagactccggctcag

SEQ ID NO: 135198 - DNA, 587 bp, Homo sapiens
  Payload ID: 6422
  Gene Symbol: FPR1
  Gene Name: formyl peptide receptor 1
  ENST ID: ENST00000594900
  CDS Start-End: 469-587
gattaatgttggttaggcagctgtcagtcttggccagaattatgccttcaggtactcaagatccctttacactcttcttccaaatagaagaagtagagccatccttcccaaggatgagatccccaacgttttatgttgaagtttctttgtgataagtgtcccataacttaaaagaatacttagcttcaaagccccaatataccacgatgcaatgagaattgggaatccacaatggaaactcctaatgaggaaaagaaaaaagggagatgtagcggacactgttctactgcaattaaccaaggccagtgggaaggaaaggtctcgctgtgtcacccaggctggagtgcagtgccacaatcatagctcactgccgccttcgcctcccgggctcaagctatcctcccacctcagccccagtccttcagctggatctacaggcacgcaccaccaagcccaggagcagacaagatggagacaaattcctctctccccacgaacatctctggagggacacctgctgtatctgctggctatctcttcctggatatcatcacttatctggtatttgcagtcacctttgtcctcgg

SEQ ID NO: 135199 - DNA, 1965 bp, Homo sapiens
  Payload ID: 6422
  Gene Symbol: FPR1
  Gene Name: formyl peptide receptor 1
  Uniprot ID: P21462
  ENST ID: ENST00000595042
  CDS Start-End: 143-1195
attagagcctgagtcactctccccaggagacccagacctagaactacccagagcaagaccacagctggtgaacagtccagcctgtctccagttggactagccacaattcaagtgcttgaaaaccacatgtggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttattattgacttcttttttgattttggacctcagccttgggtggtcagggtgggaaatgataggaagaagctgtcatctgcatcctagtttgcctgaaatgaacccaaataatacccattattattagtcctgaattatgagtagtgaatgatacccatcattctggcatcatgatgagtagtgtccacttccattctgaaaagtgccctgctgtgaaaaataaattatatagtcatcctaggtaaatgaaggaggagggagaagtgtgaaagagtatggcttaaatcagacaagatatacaagaagatactttatatagggcaggagcggtggctcatgcctgtaatcccagcactttgggaggccgaggcaggcggatcaccaggggtcaggaattcgagaacagcctggccaacatggtgaaaccctgtctctactaaaaatacaaaaattagctgggcgtagtggcaggctcccgtaatcccagctactcaggagaccgaggcaggagaatcgcttgaacctggaaggcggaggttgtagtgagccaagaaaacgccactacactccagcctgggtgacagagagagactccggctcag

SEQ ID NO: 135200 - DNA, 742 bp, Homo sapiens
  Payload ID: 6422
  Gene Symbol: FPR1
  Gene Name: formyl peptide receptor 1
  ENST ID: ENST00000600815
  CDS Start-End: 168-742
tgagatcagaggcaagaaagttgaggatgtggtacaatgattatcaagcataaagtccttcatcgatggcagccaccaaggcctgtgttcattgcaaatcacaggatttttcccttgaaccataattggacaaaattgcacaggttttcctctctggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaa

SEQ ID NO: 135201 - DNA, 2262 bp, Homo sapiens
  Payload ID: 6423
  Gene Symbol: FPR2
  Gene Name: formyl peptide receptor 2
  Uniprot ID: P25090
  ENST ID: ENST00000340023
  CDS Start-End: 395-1450
atcatatttgggcttgattgcgtggctgaaactcttcccacttcagtaattgtttctttcattttcatgaaactctgaagaaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattcaccagtgaa

SEQ ID NO: 135202 - DNA, 1544 bp, Homo sapiens
  Payload ID: 6423
  Gene Symbol: FPR2
  Gene Name: formyl peptide receptor 2
  Uniprot ID: P25090
  ENST ID: ENST00000598953
  CDS Start-End: 190-1245
aaaaggagcttagctgctggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataa

SEQ ID NO: 135203 - DNA, 2621 bp, Homo sapiens
  Payload ID: 6423
  Gene Symbol: FPR2
  Gene Name: formyl peptide receptor 2
  Uniprot ID: P25090
  ENST ID: ENST00000598776
  CDS Start-End: 773-1828
ggaccaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggactcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattc

SEQ ID NO: 135204 - DNA, 576 bp, Homo sapiens
  Payload ID: 6423
  Gene Symbol: FPR2
  Gene Name: formyl peptide receptor 2
  ENST ID: ENST00000599326
  CDS Start-End: 167-576
aagaagcacacaggaaaaggagcttagctgctgagttttgctcttgttgcccaggctggagtgcaatggcacgatctcagctcactgcaacctccgcctccctggttcaagcgattctcctgcgtcagcctcccgagcatctggaattacaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccg

SEQ ID NO: 135205 - DNA, 985 bp, Homo sapiens
  Payload ID: 6423
  Gene Symbol: FPR2
  Gene Name: formyl peptide receptor 2
  ENST ID: ENST00000600258
  CDS Start-End: 721-985
gctttaatggcattaggacagtgggctgggcctgtttagaaactcatgtacctgactgtatttctcagcctcagtctctgtgggatgcagaggttcagtgctctcaacaacaagggccaagaaatccaagtgtccgggcccctgctccctccaagggtcaaggtaaagaaagcagcaagcactgtggtgagaagaatcagagggaggcaatgaaaggaagagaagaagtcatgagggatggagaccagaaacacagagagaggtggtccgcagagcccatgtctgattgatctctatgtctccagcagccagcaaggaagcacctctttagagacctgcacctatacaatacctaccaccttttatttctcgatatgtgaactccattgagaacaaacgagtaaataaggaagggctggacattcagattccttgacccttgacatttggaagcatgaactccagtctctcacagaaggctagaggtgaaggaacattcagacacattggtttctaagaagagtccgctgacaacatacccaaggtgtcttctgaaaattataagaaatcctgagtttctgttaggggattggctccagctccattgtccctcccccatcattcagtagtctccgcgaaagcccttagagccggtgttgctccacaggaagccaagaagcacacaggaaaaggagcttagctgctggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggag

SEQ ID NO: 135206 - DNA, 543 bp, Homo sapiens
  Payload ID: 6423
  Gene Symbol: FPR2
  Gene Name: formyl peptide receptor 2
  ENST ID: ENST00000600722
  CDS Start-End: 170-543
tatgagccttgtaatcctcttggtgaagtgatcagcccgataagcgaaatgcatattgataatgatgggaatatggaggactatcccttcccaaaggagcatccaagagaatgccaattctatagcaccgttgtcaacaaggcttggtagatagagtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcat

SEQ ID NO: 135207 - DNA, 2620 bp, Homo sapiens
  Payload ID: 6424
  Gene Symbol: FPR3
  Gene Name: formyl peptide receptor 3
  Uniprot ID: P25089
  ENST ID: ENST00000339223
  CDS Start-End: 180-1241
actcattttgttttatagcatgacaggctgtctgattccatctttataaccaaagccaattaagatcttaaaaccaaacatataacttcatctttttacaagtacttagagcctgagttgctccacaggaatccaggaactgggcacaggaaaaggatctaagctggtggtgtgggaagatggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttggctcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcagcgtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacagacaccacttctgcttcacctcctgaggagacggagttacaagcaatgtgaggtcggggatatttttgggctctgtctctttctaccctgcgttaagcggaaaaaaaaaattctgacagtgtttttcttcctctttcataccaccaccaccacaatcatcaacataaaggaagtctgtaccaaatctgtagggggtttttcccacaaccaagcaatagacaccagctgggtgtcctacaattaaattccaacactatctacctggagctactgtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatattaacgtgatcatattatttttattctttcatttacataattataaattagattaagttttcaatgttaagctacccttgcatttatgaaataaaccacgcttgctcatg

SEQ ID NO: 135208 - DNA, 2222 bp, Homo sapiens
  Payload ID: 6424
  Gene Symbol: FPR3
  Gene Name: formyl peptide receptor 3
  Uniprot ID: P25089
  ENST ID: ENST00000595991
  CDS Start-End: 163-1224
atgaggtgttgtctgattctagaattatgaataaagccaataaaaactttacactaaattagttgtaattttgtcttttgacaaatccttggagcttgtgttgctcgacaggaagccagggactggccacaagaaaaggaactcagctagtggtgtgggaagatggaaaccaacttctccattcctctgaatgaaactgaggaggtgctccctgagcctgctggccacaccgttctgtggatcttctcattgctagtccacggagtcacctttgtcttcggggtcctgggcaatgggcttgtgatctgggtggctggattccggatgacacgcacagtcaacaccatctgttacctgaacctggccctagctgacttctctttcagtgccatcctaccattccgaatggtctcagtcgccatgagagaaaaatggccttttggctcattcctatgtaagttagttcatgttatgatagacatcaacctgtttgtcagtgtctacctgatcaccatcattgctctggaccgctgtatttgtgtcctgcatccagcctgggcccagaaccatcgcaccatgagtctggccaagagggtgatgacgggactctggattttcaccatagtccttaccttaccaaatttcatcttctggactacaataagtactacgaatggggacacatactgtattttcaactttgcattctggggtgacactgctgtagagaggttgaacgtgttcattaccatggccaaggtctttctgatcctccacttcattattggcttcagcgtgcctatgtccatcatcacagtctgctatgggatcatcgctgccaaaattcacagaaaccacatgattaaatccagccgtcccttacgtgtcttcgctgctgtggtggcttctttcttcatctgttggttcccttatgaactaattggcattctaatggcagtctggctcaaagagatgttgttaaatggcaaatacaaaatcattcttgtcctgattaacccaacaagctccttggccttttttaacagctgcctcaacccaattctctacgtctttatgggtcgtaacttccaagaaagactgattcgctctttgcccactagtttggagagggccctgactgaggtccctgactcagcccagaccagcaacacagacaccacttctgcttcacctcctgaggagacggagttacaagcaatgtgaggtcggggatatttttgggctctgtctctttctaccctgcgttaagcggaaaaaaaaaattctgacagtgtttttcttcctctttcataccaccaccaccacaatcatcaacataaaggaagtctgtaccaaatctgtagggggtttttcccacaaccaagcaatagacaccagctgggtgtcctacaattaaattccaacactatctacctggagctactgtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcag

SEQ ID NO: 135209 - DNA, 6866 bp, Homo sapiens
  Payload ID: 6425
  Gene Symbol: FYTTD1
  Gene Name: forty-two-three domain containing 1
  Uniprot ID: Q96QD9
  ENST ID: ENST00000241502
  CDS Start-End: 223-1179
cgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatgatttattctcagctctaaagattgagttgtggtttttagattgttctatgttacgaagaactttgtagtggttatctatatttgtagtttttagggtgtgaaaccttatctactagcaaaattggtaaatcactgtagactcttctattagcatccctctctcttttgatgatttcatttgtagctccaacaaatgaatctaaaaagaagaatccaggctgggcacggtggctcatgcctgtaatcccagaacttggggaggccaaggcgggcggatcatgaggccaggagcaagaccagcctggctaacatagggagactctatctttactaaaaatacagacattagctggtgtggtgacatgtgcctgtggtcccagctacttgggaggctgaggcgggagaattgcttgaatccaggaagcagagattgcagtgagccgagaccacgccattgcactccagcctgggtgacagagtgacactctgtcttaaaaaaacaaaaaaaaagaatccagtatactttgcaatgcagaatattgggttagatgagcctttagagactaatccagtttaacccctcctttttacaccttagtaaagtgagtcctagtgttttcaagacttgcatgtggcagagttattttttgagctcagatcttctaattcttaattgataataaactgctttggtgaattaacacccacagaaaatagtggaatggtgtgtggttttcaaatacctaagaattggtaatagccatgctttagcatttttagcatggtaagtaaatctattctaccagtgatggttatactttattactttgctatttgggttaggtagacctgttagaaaagtccagtgttcctaatcagatatgcattttttaaaaacaggcataaactcttcaccacaattttaattacagtcatccctcagtatacacggaggattggttccaggacccttgtatatacccaaccctgcgcaatactgaagtcccacatctgtgtaaacgaaaagttggcccactgtgtacatggattttccattccaagatgtttttttggttcaaaacaatttgcttataagtagacccaggtaattcaaagccatgttgttgaagggccaactgtttaagccaatcgtaaaatactgtgtctgaggaaacaggcctcattgctcagcagtgagtttttattagactaggtatgtatatcattattaatattttactgtaaatagctttgtaattcacacaaagtatacgggcccagcaggcctcattgctcagcagtgagtttttattagactaggtatgtatatcattattaatattttactgtaaatagctttgtaattcacacaaagtatacgggcccagaataatttttgttgatttatttttactataaggagataagagaaaaaatagctcacttggcagcacagaaaatgaataccatattggcaatattaaagcagaaaataattcatttctgatcagtagtgctttcagttttcatcagaattattattattattattattttgccactgtgaaaaagcagttaagcatgtaaaacttccctttagagagggttctttttggatagatcaatttggaactagcttcttttttttttttttaaatgatacttcagtaaacacagcatttacaacaagaattgtggactatggtggaccattaatagggatttaaagatttacttagaaattgtagacttctaatatcttttatttcccttctcaccacagtttattttcttttttctttttctttttttttttttcttttttttctttttttgagatggagtttcactcttgttgcccaggttggagtgcaatggtgcgatctcggctcaccccaacctccgcctcccgggttcaagcaattctcctgcctcagcctcccaagtggctgggattacaggtgcccaccaccatgcccagttaattttgcatttttagtagagacggggtttctccatgttggtcaggctggtctcaaactcctgacttcaggtgatctgcctgcctcggcctcccaaagtgctgggattacaggtgtgagccaccgcacccagcctacagcttattttctacctatgtttaacaggaagcttgataacacaagcaaatgtgatgccattctgggactgaaatgtcgtcttatgagtgtattcagatgaggtataccagtgtttaaagattagttggaagttattctcctagtgtgcatatttaatttctacttactccatttccctttaatgagaaaagaatcatattgtctgaattttcctgtataaagtttaaaaaagttaattattaggacttgtttttaaaggagtaagcaatggaaggatcaaacatttattaaatatattcagcaaatatttagaattaaatgtattcagcaaggaagagaatgggattcatactgcttggagtttataaaagcggagtttttttattttttgagacggaatactctgtcacccaggctgcagtgcagtggcacaatctcggctcactgcagcctctgcctcccaggatcctttccgggttcaagcaattcttgtccctcagcctcgtaagtaggtgggattacaagcttgagccaccacagccaactaatttttgtgtttttagtagaaatgagttttcaccatgttggccaggctggtctcgaactcctaccctcaggagatctgcctgcctcagcttcccaaagtgctgggattacaggtgtgagccaccacgcccgccctaaaagtggattcttttttttttttttttttttggagacagtcttgctctgttgcccaggctggagtgcagtagtgatcttggctcactgcagcctctgcctcccgggttcaagcgattttcctgtctcaaccttccaagtatctgggattacaggcacgtgccactacacccagctaatttttgtactaagacgaggtttcaccatattggccagtctagtctcaaactcctgacctcaggtgatatgcccgcctctgactcccaaagtgctgggattacaggcatgagctacggagcccggcctagaagtggagtcttagaaggagtgaccatgatatgtttctactgagtagaagggggaagggaggacataacctttgcatgatatagtgaaatgcagagctggaaagaactattaagatttgagtgaaacttttgccccctgtgttgaatgagttaactttcagtctgtaaaataaacaggaagaactgggaa

SEQ ID NO: 135210 - DNA, 491 bp, Homo sapiens
  Payload ID: 6425
  Gene Symbol: FYTTD1
  Gene Name: forty-two-three domain containing 1
  ENST ID: ENST00000426031
  CDS Start-End: 279-491
agttgccggcggagttttctcgctggtgggcggacccgagcggaggcccggaggacagccgggagcgcaggctcgacgccaggtgcccggctggaccgcgagggacccgggcgtcccctcggccgcggcagtcggaggaggggctgtggaggcgggggcaggggcgctgcgggcccgaagatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaa

SEQ ID NO: 135211 - DNA, 1342 bp, Homo sapiens
  Payload ID: 6425
  Gene Symbol: FYTTD1
  Gene Name: forty-two-three domain containing 1
  Uniprot ID: Q96QD9
  ENST ID: ENST00000415708
  CDS Start-End: 239-1117
gaaaggctcgtgtgtaccgaagtataggggacctgtctgcagcaggagggactcgaaggacacggaggattatatcactgaaggcataagattcagagtagagacgggatttcaccatgttggtcaggccagtcccgaactcctgacctcaaatgatccgcccacctcagcctcccaaagtgctgggattataggtgtgagtcaccatgcctggccggaagggggtcatctttaaaaaatggagccttctgtgattatgggaaatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttgg

SEQ ID NO: 135212 - DNA, 1758 bp, Homo sapiens
  Payload ID: 6425
  Gene Symbol: FYTTD1
  Gene Name: forty-two-three domain containing 1
  Uniprot ID: Q96QD9
  ENST ID: ENST00000424384
  CDS Start-End: 532-1287
acggctcgccgctcgccggctctttgtgaggaaagatctgccggtttccccggagcgcgttcgcggtgggcgttatcggggagcgaggggaatggtccgaccgagccgttctctctgaagaaaggtcttggagagcccggccggggctgcggtcggttaaaccagcgcttccggagctttccctggtcgccgggcgttccaggccggcgccggccatggctgccgggcgcgactctcggggccacctccggccgcggccccggagcgtctgtcagaaaggaagcagcgctcggccgcctgtgggatgtggttgtgtattgagcgctgcctagaaaagcacagtctccctctccaggcctcagagctagctaatgggggagaaagcaaacatctttgaaggagagatgattgctgtggctcgctgagaagccagatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagaca

SEQ ID NO: 135213 - DNA, 718 bp, Homo sapiens
  Payload ID: 6425
  Gene Symbol: FYTTD1
  Gene Name: forty-two-three domain containing 1
  ENST ID: ENST00000428738
  CDS Start-End: 189-718
gcgtatccttattcacccccgtgacattacacgctggggaccgaactcagtccgagatgtagactaggcaataacgctaatctaatcccgatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagt

SEQ ID NO: 135214 - DNA, 593 bp, Homo sapiens
  Payload ID: 6425
  Gene Symbol: FYTTD1
  Gene Name: forty-two-three domain containing 1
  Uniprot ID: Q96QD9
  ENST ID: ENST00000418169
  CDS Start-End: 35-424
gtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccacc

SEQ ID NO: 135215 - DNA, 998 bp, Homo sapiens
  Payload ID: 6425
  Gene Symbol: FYTTD1
  Gene Name: forty-two-three domain containing 1
  ENST ID: ENST00000412924
  CDS Start-End: 95-460
ccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctgacacaaaaactttggagtcctcaattgttaagcatatgaagaggttcgtgcttgtaatcccagcactttgggaggtgagagcaagaggattgcttaagccaaggacttcaggaccagcgtgggcaacatagggagaccccgtctctacaaaaaaaaagaaagagtataaagaggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagt

SEQ ID NO: 135216 - DNA, 719 bp, Homo sapiens
  Payload ID: 6425
  Gene Symbol: FYTTD1
  Gene Name: forty-two-three domain containing 1
  ENST ID: ENST00000494309
  CDS Start-End: 1-381
ggctgcgttgcggtgggcgcgaaaggctcgtgtgtaccgaagtataggggacctgtctgcagcaggagggactcgaaggacacggaggattatatcactgaaggcataagattcagagatgatatcatcaagttgaatcgaaaggaagggaagaagcagaattttccaagactaaatagaagactcctccagcaaagtggtgcccagcaattcaggatgagagtgcgatggggaatccaacagaattctgacacaaaaactttggagtcctcaattgttaagcatatgaagaggttcgtgcttgtaatcccagcactttgggaggtgagagcaagaggattgcttaagccaaggacttcaggaccagcgtgggcaacatagggagaccccgtctctacaaaaaaaaagaaagagtataaagaggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtgga

SEQ ID NO: 135217 - DNA, 1669 bp, Homo sapiens
  Payload ID: 6426
  Gene Symbol: FOSL1
  Gene Name: FOS-like antigen 1
  Uniprot ID: P15407
  ENST ID: ENST00000312562
  CDS Start-End: 188-1003
acgggccaaggcggcgcgtctcgggggtggagcctggaggtgaccgcgccgctgcaacgcccccaccccccgcggtcgcagtggttcagcccgagaacttttcattcataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtgg

SEQ ID NO: 135218 - DNA, 1427 bp, Homo sapiens
  Payload ID: 6426
  Gene Symbol: FOSL1
  Gene Name: FOS-like antigen 1
  Uniprot ID: P15407
  ENST ID: ENST00000448083
  CDS Start-End: 81-590
ataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcaggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtggcctgagtgcctcactggacccagaggccaatgggagagtatttggagccctaggtcccagccttagctctacagactcactgcatgaccttggacaaattctttgatatttttggactttgtcttatctgacaagtggggctacatccgctcggcctcatctccgggactg

SEQ ID NO: 135219 - DNA, 1132 bp, Homo sapiens
  Payload ID: 6426
  Gene Symbol: FOSL1
  Gene Name: FOS-like antigen 1
  ENST ID: ENST00000532401
  CDS Start-End: 81-488
ataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaat

SEQ ID NO: 135220 - DNA, 584 bp, Homo sapiens
  Payload ID: 6426
  Gene Symbol: FOSL1
  Gene Name: FOS-like antigen 1
  ENST ID: ENST00000534222
  CDS Start-End: 547-584
aaaaggctgcagccggacttggggaggcgtcgccaagttcgggaccgacgggccaaggcggcgcgtctcgggggtggagcctggaggtgaccgcgccgctgcaacgcccccaccccccgcggtcgcagtggttcagcccgagaacttttcattcataaaaagaaaagactccgcacggcgcggatcagcccggaggaagaggagcgccgccgagtaaggcgcgagcggaacaagctggctgcggccaagtgcaggaaccggaggaaggaactgaccgacttcctgcaggcggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcct

SEQ ID NO: 135221 - DNA, 1200 bp, Homo sapiens
  Payload ID: 6426
  Gene Symbol: FOSL1
  Gene Name: FOS-like antigen 1
  ENST ID: ENST00000531493
  CDS Start-End: 81-788
ataaaaagaaaagactccgcacggcgcgggtgagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacaggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaa

SEQ ID NO: 135222 - DNA, 6708 bp, Homo sapiens
  Payload ID: 6427
  Gene Symbol: FOSL2
  Gene Name: FOS-like antigen 2
  Uniprot ID: P15408
  ENST ID: ENST00000264716
  CDS Start-End: 864-1844
gtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaa

SEQ ID NO: 135223 - DNA, 5829 bp, Homo sapiens
  Payload ID: 6427
  Gene Symbol: FOSL2
  Gene Name: FOS-like antigen 2
  Uniprot ID: P15408
  ENST ID: ENST00000379619
  CDS Start-End: 9-965
gaatccacatggtacagggctggagaataaagagtaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcgattggtccctggcaggttgctgtccctcacatccctctctttccgtggcaggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaa

SEQ ID NO: 135224 - DNA, 889 bp, Homo sapiens
  Payload ID: 6427
  Gene Symbol: FOSL2
  Gene Name: FOS-like antigen 2
  ENST ID: ENST00000436647
  CDS Start-End: 282-889
caggatgtgagcggaggcaattcccggttttggaagaaaatcagacaggaaaccagtgctaggaagaaggaagagaactcagtccagcagagtgtaatagggcctcattaccgaagcaaaaagcagctgttggctaattcctagcatgctgtaacacatgagtattttgcaattagcaataaccagtgcacggggtttcgcatagacgcctgcccattcggcccggcagtgtgtgaggcgcctttcaaaccggagggattggcaagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggccca

SEQ ID NO: 135225 - DNA, 2458 bp, Homo sapiens
  Payload ID: 6428
  Gene Symbol: FHL1
  Gene Name: four and a half LIM domains 1
  Uniprot ID: Q13642
  ENST ID: ENST00000345434
  CDS Start-End: 82-1053
caaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135226 - DNA, 1017 bp, Homo sapiens
  Payload ID: 6428
  Gene Symbol: FHL1
  Gene Name: four and a half LIM domains 1
  ENST ID: ENST00000370674
  CDS Start-End: 246-1017
atttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtga

SEQ ID NO: 135227 - DNA, 833 bp, Homo sapiens
  Payload ID: 6428
  Gene Symbol: FHL1
  Gene Name: four and a half LIM domains 1
  ENST ID: ENST00000370676
  CDS Start-End: 88-720
gtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctc

SEQ ID NO: 135228 - DNA, 2565 bp, Homo sapiens
  Payload ID: 6428
  Gene Symbol: FHL1
  Gene Name: four and a half LIM domains 1
  Uniprot ID: Q13642
  ENST ID: ENST00000370683
  CDS Start-End: 341-1231
gccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135229 - DNA, 2441 bp, Homo sapiens
  Payload ID: 6428
  Gene Symbol: FHL1
  Gene Name: four and a half LIM domains 1
  Uniprot ID: Q13642
  ENST ID: ENST00000370690
  CDS Start-End: 265-1107
cccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135230 - DNA, 2374 bp, Homo sapiens
  Payload ID: 6428
  Gene Symbol: FHL1
  Gene Name: four and a half LIM domains 1
  Uniprot ID: Q13642
  ENST ID: ENST00000394153
  CDS Start-End: 198-1040
taacaatgctgagtgtttgagctaatacggcttgataatgagggagccagatccactgccagtgctcatgttatatgataaacagacatttggagaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135231 - DNA, 2706 bp, Homo sapiens
  Payload ID: 6428
  Gene Symbol: FHL1
  Gene Name: four and a half LIM domains 1
  Uniprot ID: Q13642
  ENST ID: ENST00000394155
  CDS Start-End: 330-1301
cccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135232 - DNA, 629 bp, Homo sapiens
  Payload ID: 6428
  Gene Symbol: FHL1
  Gene Name: four and a half LIM domains 1
  ENST ID: ENST00000458357
  CDS Start-End: 165-629
acctcttggttctttcagccaggatagctagcaggggctgtggggagcgggtgaggatgaagcggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgag

SEQ ID NO: 135233 - DNA, 926 bp, Homo sapiens
  Payload ID: 6428
  Gene Symbol: FHL1
  Gene Name: four and a half LIM domains 1
  ENST ID: ENST00000420362
  CDS Start-End: 314-926
gcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggagg

SEQ ID NO: 135234 - DNA, 796 bp, Homo sapiens
  Payload ID: 6428
  Gene Symbol: FHL1
  Gene Name: four and a half LIM domains 1
  ENST ID: ENST00000452016
  CDS Start-End: 175-796
aggcagtctgactctggtgcccctgctgtgaagagctgtgccctgctgcattcctcctgtagctgcacgaaagggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtatt

SEQ ID NO: 135235 - DNA, 775 bp, Homo sapiens
  Payload ID: 6428
  Gene Symbol: FHL1
  Gene Name: four and a half LIM domains 1
  ENST ID: ENST00000456445
  CDS Start-End: 159-775
gagggagccagatccactgccagtgctcatgttatatgataaacagacatttggagaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggacca

SEQ ID NO: 135236 - DNA, 796 bp, Homo sapiens; identical to SEQ ID NO: 135234
  Payload ID: 6428
  Gene Symbol: FHL1
  Gene Name: four and a half LIM domains 1
  ENST ID: ENST00000434885
  CDS Start-End: 175-796

SEQ ID NO: 135237 - DNA, 539 bp, Homo sapiens
  Payload ID: 6428
  Gene Symbol: FHL1
  Gene Name: four and a half LIM domains 1
  ENST ID: ENST00000449474
  CDS Start-End: 117-539
tttttccctaacttaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttc

SEQ ID NO: 135238 - DNA, 2310 bp, Homo sapiens
  Payload ID: 6428
  Gene Symbol: FHL1
  Gene Name: four and a half LIM domains 1
  Uniprot ID: Q13642
  ENST ID: ENST00000539015
  CDS Start-End: 47-976
gttaagctatgccagagccgagtccaaattttattccggtacagggatgactttctatgtggcctctctggctctggagctaatttggatgctgagtagccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgc

SEQ ID NO: 135239 - DNA, 2878 bp, Homo sapiens
  Payload ID: 6428
  Gene Symbol: FHL1
  Gene Name: four and a half LIM domains 1
  Uniprot ID: Q13642
  ENST ID: ENST00000543669
  CDS Start-End: 712-1554
acacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatg

SEQ ID NO: 135240 - DNA, 2325 bp, Homo sapiens
  Payload ID: 6428
  Gene Symbol: FHL1
  Gene Name: four and a half LIM domains 1
  Uniprot ID: Q13642
  ENST ID: ENST00000535737
  CDS Start-End: 185-1027
ctctggtgcccctgctgtgaagagctgtgccctgctgcattcctcctgtagctgcacgaaagggtgtggaatcttctagaaacagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgta

SEQ ID NO: 135241 - DNA, 2178 bp, Homo sapiens
  Payload ID: 6428
  Gene Symbol: FHL1
  Gene Name: four and a half LIM domains 1
  Uniprot ID: Q13642
  ENST ID: ENST00000618438
  CDS Start-End: 194-778
ccgcagccgccgccgccaccgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 135242 - DNA, 1335 bp, Homo sapiens
  Payload ID: 6428
  Gene Symbol: FHL1
  Gene Name: four and a half LIM domains 1
  Uniprot ID: Q13642
  ENST ID: ENST00000630084
  CDS Start-End: 261-1103
acagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaattt

SEQ ID NO: 135243 - DNA, 457 bp, Homo sapiens
  Payload ID: 6428
  Gene Symbol: FHL1
  Gene Name: four and a half LIM domains 1
  ENST ID: ENST00000627812
  CDS Start-End: 260-457
gcattcctcctgtagctgcacgaaaggattcaggtttgacgcttcagttggattgaatcgaaagagaggtatatttggtatcaggcgtttgtggtggcatgtgaaatcattatccacgtttgataacagtttgactttttgcctgctgtaataatagtagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttc

SEQ ID NO: 135244 - DNA, 580 bp, Homo sapiens
  Payload ID: 6428
  Gene Symbol: FHL1
  Gene Name: four and a half LIM domains 1
  ENST ID: ENST00000627578
  CDS Start-End: 123-580
agtccgcagccgccgccgccaccgccgcgcctcggcctcggtgcaggcagcggccgccgccgccgagacagctgcgcgggcgagcatccccacgcagtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttg

SEQ ID NO: 135245 - DNA, 1501 bp, Homo sapiens
  Payload ID: 6428
  Gene Symbol: FHL1
  Gene Name: four and a half LIM domains 1
  Uniprot ID: Q13642
  ENST ID: ENST00000629039
  CDS Start-End: 412-1254
ctgcagacaacgctgttatcaccagagcccggcactgagcttggcacatggcgagggctcagtaaactgaatgctgagtgaatgagacgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaactta

SEQ ID NO: 135246 - DNA, 578 bp, Homo sapiens
  Payload ID: 6428
  Gene Symbol: FHL1
  Gene Name: four and a half LIM domains 1
  ENST ID: ENST00000628443
  CDS Start-End: 136-578
aacgaggatggcgggggtggcgacgaggagtagacgcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggactt

SEQ ID NO: 135247 - DNA, 2304 bp, Homo sapiens
  Payload ID: 6428
  Gene Symbol: FHL1
  Gene Name: four and a half LIM domains 1
  Uniprot ID: Q13642
  ENST ID: ENST00000628568
  CDS Start-End: 133-975
gccccgctccgcatcttttgtgaatcagcacagttgatatatctgagcaggggcttctaccatctccccagggaatcactagccatcggccatctggccccgcggggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 135248 - DNA, 578 bp, Homo sapiens
  Payload ID: 6428
  Gene Symbol: FHL1
  Gene Name: four and a half LIM domains 1
  ENST ID: ENST00000628032
  CDS Start-End: 54-578
agaattcagaactttgcttctaaaaaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcact

SEQ ID NO: 135249 - DNA, 569 bp, Homo sapiens
  Payload ID: 6428
  Gene Symbol: FHL1
  Gene Name: four and a half LIM domains 1
  ENST ID: ENST00000628919
  CDS Start-End: 179-569
tccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagta

SEQ ID NO: 135250 - DNA, 566 bp, Homo sapiens
  Payload ID: 6428
  Gene Symbol: FHL1
  Gene Name: four and a half LIM domains 1
  ENST ID: ENST00000627383
  CDS Start-End: 152-566
aatctagagaagcacgaggaaggttctatcacgggggttgagccttagaaggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactg

SEQ ID NO: 135251 - DNA, 416 bp, Homo sapiens
  Payload ID: 6428
  Gene Symbol: FHL1
  Gene Name: four and a half LIM domains 1
  ENST ID: ENST00000625935
  CDS Start-End: 361-416
gtctgactctggtgcccctgctgtgaagagctgtgccctgctgcattcctcctgtagctgcacgaaagggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagta

SEQ ID NO: 135252 - DNA, 567 bp, Homo sapiens
  Payload ID: 6428
  Gene Symbol: FHL1
  Gene Name: four and a half LIM domains 1
  ENST ID: ENST00000630278
  CDS Start-End: 334-567
aggcagtctgactctggtgcccctgctgtgaagagctgtgccctgctgcattcctcctgtagctgcacgaaagggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgag

SEQ ID NO: 135253 - DNA, 1462 bp, Homo sapiens
  Payload ID: 6429
  Gene Symbol: FHL2
  Gene Name: four and a half LIM domains 2
  Uniprot ID: Q14192
  ENST ID: ENST00000322142
  CDS Start-End: 168-1007
gcagcgctccactcggccggcagcggagccgcagccaccagccgcccgcgccctccagccccgtccgggagtccccggcccgctgcggtgcctggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacag

SEQ ID NO: 135254 - DNA, 1769 bp, Homo sapiens
  Payload ID: 6429
  Gene Symbol: FHL2
  Gene Name: four and a half LIM domains 2
  ENST ID: ENST00000344213
  CDS Start-End: 129-1298
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaatcttttgccaggca

SEQ ID NO: 135255 - DNA, 1578 bp, Homo sapiens
  Payload ID: 6429
  Gene Symbol: FHL2
  Gene Name: four and a half LIM domains 2
  Uniprot ID: Q14192
  ENST ID: ENST00000358129
  CDS Start-End: 459-914
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacag

SEQ ID NO: 135256 - DNA, 1426 bp, Homo sapiens
  Payload ID: 6429
  Gene Symbol: FHL2
  Gene Name: four and a half LIM domains 2
  Uniprot ID: Q14192
  ENST ID: ENST00000393352
  CDS Start-End: 130-969
cagctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 135257 - DNA, 1531 bp, Homo sapiens
  Payload ID: 6429
  Gene Symbol: FHL2
  Gene Name: four and a half LIM domains 2
  Uniprot ID: Q14192
  ENST ID: ENST00000393353
  CDS Start-End: 235-1074
actcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 135258 - DNA, 1367 bp, Homo sapiens
  Payload ID: 6429
  Gene Symbol: FHL2
  Gene Name: four and a half LIM domains 2
  Uniprot ID: Q14192
  ENST ID: ENST00000408995
  CDS Start-End: 106-945
ctcggccggcagcggagccgcagccaccagccgcccgcgccctccagccccgtccgggagtccccggcccgctgcggtgccgttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaaga

SEQ ID NO: 135259 - DNA, 1601 bp, Homo sapiens
  Payload ID: 6429
  Gene Symbol: FHL2
  Gene Name: four and a half LIM domains 2
  Uniprot ID: Q14192
  ENST ID: ENST00000409807
  CDS Start-End: 336-1175
tcagcctcagtgactcaggcagcctcctttgtcagcaccgggcctgagtcgctaagcggctctctgactcagatgccctgaggtacaaagttccttgagcttgggtgaatggaaacattagacattgggttcttctgtgcggttttattatgagaatttgatcaaagccacatttattaagtgtccatctcaagttgcattatactgagttcgcttcctcaagatgaccatctgaaacaaaacacgtgtgctttctctagtggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattat

SEQ ID NO: 135260 - DNA, 4881 bp, Homo sapiens
  Payload ID: 6429
  Gene Symbol: FHL2
  Gene Name: four and a half LIM domains 2
  ENST ID: ENST00000409177
  CDS Start-End: 123-1310
actttggttttcccgccctggaggggaatccaagatgtctaactagtcttctggccccgagagggagaggtggggataggaccttcctttagtcccctccgtagtggaacgaaggattctttatggtcatctgtggtgttcatttcgtaaagaagcatctgcagggtaagaaggaaaaacgtccaccttgcaaatatatcccaggcacatgcctcctgagaagtgaccccctcctccctccgcctcccccggcacgtcctggggcttctccagtctcccgctcctgggaccaggcagagatcccggcgtgggcagacccctgccaccgcgcccaggcctcgtccgaaactcgcgcccgagagcccacgccggaggcgacgctcccgataactactgtgctcccaagacccggagggcacgaagaaaggagccctggcaaacaaagggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaatcttttgccaggcacagagtgtgaaatcatgattacaggtcgaggcactgagtctaagtaacactttattgcatggtcccatggtcactgtatgaagtgcagttccaatgttccaatggcctggggcattgccaactggaacagcatcacaccctttaaaggaagccttcggctgggcacggtggctcacgcctgtaatcccagcactttgggaggccaaggcgggtggatcatgaggtcaggagatcaagaccatcctggctaacatggtgaaaccccgtctctacgaaaaatacaaaaaattagccgggtgtggtggtgagcgcctgtagtcccagctactcgggaggctgaggcaggagaatggcatgaacccgggaggcagagcttgcagtgagctgagatggcaccactgaactccagcctggaagacaaagagactccgtctcaaaaaaaaaaagccttcagtcagcaccaggcacctcttccttgctaccttctctcccttttttttttttttttttgagacagagtctcgctctgtcgcccaggctaaagtgcaatggcacaatctcagctcactgcaacctccacttcccgcgttcaagcgattctcctgccctcagcctcctgagtagctgggattacaggcacccaccattatgcccggctaatttttgtatttttagtagagatggggtttcaccatgttaggctggtcttgaactcctgacctcaggtgatccacctgcctcggtcccccaaagtgctgggattataggcatgagccaccgcacccagctaccttctctgtctttcccatactctttctcttggaatgtaatcctctgcatttgacacagtaacataaactgacagtgaagccaattttcaggtcatttttcttggcagagcttatcggctctgtcccagtgttatggatccacatcttacaccgacttccataaagtgaaagattgcacaaggacataagcaacttgaggccagagacgacatcctgttcatctttatgttctcaacaccctcgcaactgagggcacactgggagccttcagtgtttctgaaaagggcagtaaagcaggagagacacacagtcattacagtaaaaataacattctgagctactagtgtggcagtagtctgtggaataatctcagatagcagtatacagttgggaagcacggagccaatgtatgggatagaacattgcacagttctctttagaatgggagcatcagtgacctttttgtccttagttttctaagacaatgcaatataataaaatgataggctgagcaacagaaaaatttggtggaaatcaagtctgatatatgctgagcatatgtgaaatcagtttcttaatctgagtgttagtcactgttagaatgtttgataatgtctggaatgagtcttttggttttatagttgacttgaggttttgcttaaaaagaataatttcatcctttgttagttgttttgctgttttctacttcataatataaaagtaaaagcactccaaatttcattttggaacatcttacttgttcctcattaaaaccatagactctcccaaccttaaattacccattctaaaattaatggttagggggaattccacttctagtaaatagctccaattggactaattctcctccaaattaacagtcattctggacaaaatatttatttaattgttaagaacactggagcacgatccaaagcaggcagatattggagggcagtagacacttggaagaagagaacgacactgggtgattttcctgtttcggccttttatccaatggcaggcccccgccagggatctaaaactctgttaggaaacctgcagtcttactggcctgaggaaccagaggccagagttcgggacaaacagcctctggaaagtgaggaagaaaatcctgaaaaggagagccccaagttcgtcgcatgaacttagaaatttctggctgacaactgaaccgtgtatacttaggccagactccaagcagcccagccaaggctaaaagcattgactgacaggactttacagatagtggtttgcagggcttagctgaccgaccctcttcctactgaaggaaattacttgtatataaaccacacaacacaaagtctctgaaaatttccccagaagcatacaacaaataaacattcattcaggaaaatccactactaagtcttagaaagaacagtgagtctgtggcatttgagccacagcctcatcctatcccatccccactccccagcttcatgtgacaaactctattctggaccaatgcagccaaaaattaaggggtctctcttcctccagctaccagtctagggctttgccccaggtgcgacaggctgagaatcgtagagctccaattgcccctaccctagcctgcttagtgcggaggctccacattgggaggggcaatctgagaagaccagcggctatcaacccactcacagagaagggatgtcagtcctggagaagcaggctgctgtccagcccccagaggagatccaggctctgagactggtaacccagcagttatgcccaaggggactggtatttggtacggagaacgagaaatctttgcctaaggggattgtcaaaaacaataagacatcttaccagtgagccattaaggaaggggctggtaactccatgctattagtagcaaaaagcaaaatgacagaccagccagaagtttaacacagaaaaccagagaaagagatagccaagaagagccctcctggaatctggtttatccttgaggttcgggaagtatgtatggacagggctgtatccactcaggagcaatcagatgtgaaacaaacttgaaagcattctctaaggcatacacagatccatcagcaaagagcagaaatcttattagctcaaagtgcttaagcagaacctctgaccaaacactggctgaacacataaatgtgtttgttcaaagaactaaaggaaatcatatttaaaaaaggaaggtaaaggaacaattacagttgttcctccatatccatggattcctcatctgtggattcaaccaactgtggatcaaaagtatttaggaaaaaaaa

SEQ ID NO: 135261 - DNA, 574 bp, Homo sapiens
  Payload ID: 6429
  Gene Symbol: FHL2
  Gene Name: four and a half LIM domains 2
  ENST ID: ENST00000447958
  CDS Start-End: 516-574
tttattaagtgtccatctcaagttgcattatactgagttcgcttcctcaagatgaccatctgaaacaaaacacgtgtgctttctctagtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggtgcccgccaccacacccggataattttttttttgtatttttagtagagatggggtttcaccgtgttagccaggatggtctcaatctcctgacctcgtgtttcacccgcctcagcctcccaaagtgctgggattacaggcgtgagccaccgcacctggccagattttttttgtttttgtttttttctgtcctggtcctgtagaatcagaggaagtggaaaacacatatcaggttgctgaaaagccaggagtcaaaatgactgagcgctttgactgccaccattgcaacgaatctctctttggcaagaagtacat

SEQ ID NO: 135262 - DNA, 886 bp, Homo sapiens
  Payload ID: 6429
  Gene Symbol: FHL2
  Gene Name: four and a half LIM domains 2
  ENST ID: ENST00000452732
  CDS Start-End: 76-240
tggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggcatgctgatgtgctctttcctccatctggggacttaatgaccggagcactggctgtggtgacatctagtggctttgctttcctgttgaccttggagatttctctctcagtttttcttgaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcgg

SEQ ID NO: 135263 - DNA, 1876 bp, Homo sapiens
  Payload ID: 6429
  Gene Symbol: FHL2
  Gene Name: four and a half LIM domains 2
  ENST ID: ENST00000530340
  CDS Start-End: 129-563
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 135264 - DNA, 759 bp, Homo sapiens
  Payload ID: 6429
  Gene Symbol: FHL2
  Gene Name: four and a half LIM domains 2
  ENST ID: ENST00000607522
  CDS Start-End: 140-337
agctggctggcagctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacctgctgcgggcctctgcgggtccccggcgctcccctaggaaacacgggtttctctgtggtttgtgctgaagccctgatccaccactgaagtctgtctcttgagccccctctgaggggcgtggaccctgcgtgtagcctttcggaagcttcttccctctagcgaatgtgatctctgcccacaagcactgggtgagggccttgccaggacttttgtgcttagtatctctaagtacattttctgtattctagcaattagtgcccttatctaactacccagctgcctaccaatactggaactttcttaagggtggtgctctcttcctcttgtctgtttgccccgtggtgagtaacgtggagcaggtgctgtgctcagtcaatatttgatgaatgaatgtgtacatgagagaaccagagttggttcctggataaatgggcacataaaagcacaaagtccttggaa

SEQ ID NO: 135265 - DNA, 1647 bp, Homo sapiens
  Payload ID: 6430
  Gene Symbol: FHL3
  Gene Name: four and a half LIM domains 3
  Uniprot ID: Q13643
  ENST ID: ENST00000373016
  CDS Start-End: 170-1012
cacggtccgtctgcagtcggcagcctcgccggcagctcgctcggcccccgcttggcccggcccgcaggtaggagccgccgagggacgcggcgcccggttcccggccccgcctgcgccgcgcgctccccgctcccgccgcccgcttcgagggttctctccccttgccaccatgagcgagtcatttgactgtgcaaaatgcaacgagtccctgtatggacgcaagtacatccagacagacagcggcccctactgtgtgccctgctatgacaatacctttgccaacacctgtgctgagtgccagcagcttatcgggcatgactcgagggagctgttctatgaagaccgccatttccacgagggctgcttccgctgctgccgctgccagcgctcactagccgatgaacccttcacctgccaggacagtgagctgctctgcaatgactgctactgcagtgcgttttcctcgcagtgctccgcttgtggggagactgtcatgcctgggtcccggaagctggaatatggaggccagacatggcatgagcactgcttcctgtgcagtggctgtgaacagccactgggctcccgttcttttgtgcccgacaagggtgctcactactgcgtgccctgctatgagaacaagtttgctcctcgctgcgcccgctgcagcaagacgctgacacagggtggagtgacataccgtgatcagccgtggcatcgagaatgtctggtctgtaccggatgccagacgcccctggcagggcagcagttcacctcccgggatgaagatccctactgtgtggcctgttttggagaactctttgcacctaagtgcagcagctgcaagcgccccatcgtaggactcggtggaggcaagtatgtgtcctttgaagaccgacactggcaccacaactgcttctcctgcgcccgctgctctacctccctggtgggccagggcttcgtaccggatggagaccaagtgctctgccagggctgtagccaggcagggccctaagccagggctcctggacccaggctttcccataccacgggcccaggactgtggctccttttctaaaccacctctgggactcagctccccccgccaaaaaaaatgggtctccttctgggctccaggattgtctccccactccagcatccccaaactggtactccctgacccagggccccaaacctgggctcttacagagcctccatgagtcaagccccctccccacacctggactccagaattcaccctctcccctgcagtctgggttcccagactgagtcctctccccaaatcagggctctagacccgagccctccaaacctggactctgggacttaggcccccttaaatctagacttctctttataggtttcaggtctcctatgggtgcctgggaagtccttgaaagtggactgttctcaggcttgacctgccccaccccatccccgcggttgaggctgtgggggcagcagatcaggagcccactgataaggggccctagggtacagggtgctgcccagcaggtcgccaccgagtgtcttctcattttatttcagctccattttgcccatagatgggcagaggggtgagattggctcatcccccttccagattctgcaataaagcggtgtgaggaa

SEQ ID NO: 135266 - DNA, 2031 bp, Homo sapiens
  Payload ID: 6431
  Gene Symbol: FHL5
  Gene Name: four and a half LIM domains 5
  Uniprot ID: Q5TD97
  ENST ID: ENST00000326771
  CDS Start-End: 381-1235
tgcaagtccagagagcagggaactaccttgagtattctactcaaacttatgtctcagagttccccaatttcccaagaagggagagatagaggccacaatccagggggccatctcttaaggtaccaataattttgcagcccagtaggagtcatgtacacggtataagacttggaggaaatgcagggacccttctgttttctcctgcaaagttgaaaaagctgcatgcagttggaagggatcttcagatggtgctggtgactttctgttccttttggagttgacatgcatgtggattggaggaaaaataatcaacatatattctcctttcgtactgtttaaatcacaggaagaagcggctttaagacaaagatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaa

SEQ ID NO: 135267 - DNA, 779 bp, Homo sapiens
  Payload ID: 6431
  Gene Symbol: FHL5
  Gene Name: four and a half LIM domains 5
  ENST ID: ENST00000450218
  CDS Start-End: 150-779
tgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgc

SEQ ID NO: 135268 - DNA, 1904 bp, Homo sapiens
  Payload ID: 6431
  Gene Symbol: FHL5
  Gene Name: four and a half LIM domains 5
  Uniprot ID: Q5TD97
  ENST ID: ENST00000541107
  CDS Start-End: 186-1040
aggaagcaggcagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggatcaaaccaaaatgacaactgctcacttttactgtcaatactgcacagcatcacttcttgggaagaaatatgtactaaaggatgacagtccatactgtgttacatgttatgatcgtgtattttctaactattgcgaggaatgcaaaaaaccaattgaatctgattctaaggatctttgttacaaagaccggcactggcatgaaggatgcttcaagtgcaccaaatgcaatcactctttggtggaaaagccttttgctgccaaggatgagcgcctgctgtgcacggagtgctattctaacgagtgctcctccaagtgcttccactgcaagaggaccatcatgcctggttcccgcaaaatggaatttaagggaaactactggcatgaaacctgttttgtgtgtgagaattgccgacaacctatagggacaaagcctttgatctccaaagagagtggcaattattgtgtgccatgttttgagaaggagtttgctcactactgcaacttttgtaagaaggtgataacttcaggtgggataacattttgtgaccagctatggcataaagagtgttttctgtgtagtggctgtaggaaagatctctgtgaagaacagttcatgtccagagacgactatccattctgcgtggactgctacaaccatctttatgccaacaagtgtgtagcctgttccaaacccattagtggtctcacaggtgccaagtttatctgctttcaagacagccagtggcatagcgaatgctttaactgcgggaaatgctctgtctccttggtgggtaaaggcttcctgacccagaacaaggaaatcttctgccaaaaatgtggctccggaatggacactgacatctaggagacagtccttgcccacctaaaatccattttgccttcgttgtcactaaagccagaactcagttgcggtcttatttttgacttaagttttagaaaatattcatgtagtttagagtggaaaagtttttgcacacattttgatcgaactatattctaagcacacaaaaagcacagtagaacagaaatgaatatatgctaaatcacaaagacaactctccttgcaaaatactgcactctgctgttagaagcagaggaaaatatctcttcataatcaaatatatgacatatacctaggagctgtggatgtaattactgaagaatgaggtttttcatacctgaagagtaaaagaaaaactaagagatcaaactgagaggtatacatgaggctagtgtttgcattcctggttatatgtaatgtgataaattagctatgaatggtaaaagaacaaaactgatcagagtaaattcattagcaattatcacatttaagaattgttatcatttaaaaatcatcctttttttcacacatactgactgtagaattaaaaaacaaagctacaatttgccctcatacacactgcttccacagcttgctagttctgtgtttactcaatggaatatgagaactgaggacattatggctctcataatctgcataggtataaagaggatcatttctacctagggatagccaaagcatgggtttcaacacgttttgtattaaatatattttcaaagtccacagtgatttttctaaacgcttacagattccatgaaataaaagtctattctttcaagtggagctaaccaggataatctttgtccccaaaggcaaacctttaaaataaatagatcattaaatctt

SEQ ID NO: 135269 - DNA, 2450 bp, Homo sapiens
  Payload ID: 6432
  Gene Symbol: FJX1
  Gene Name: four jointed box 1
  Uniprot ID: Q86VR8
  ENST ID: ENST00000317811
  CDS Start-End: 219-1532
acagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacccgcaaaggtgtctaaaaacttcagcttttcacccacctgcccctttctttcaatcccacgctgtttcctttcaaagttctgggaggacgaactcaccgaggcgagaagtgtaacattctctccacccagcttataaaaggattctttactgtgccagcacggggattggatccgaagaaactggctactggggtttggcccccgagtggccgtccctgtgggagatgcaccccattcttgggccccccctcattccctttccgaaaaaggaaaacttgcgtttgagccgttgagctaattctgcaattttctaccaaacagagcgctggtggccccggagcagggctgtgacattggctggtggagcccccttcctgtgttctccctttgttccagcgccgcgatggtgagatcactgttccaagcagggggacggctcgcgataggacaaagagagcaggacctccagactctggggagccctgcagaccttgacaatttgcctgactcattcctgacctcttgtcattttggcctgaaggctacaaattcagggtcagctgtatgcactaagtcaaataatgaatttcttcctccctctcgcaaccgaccaaaattttgacaacgatgatgttcaccagaaggaaaaaaaaaaatcagttttatgcactttattttgttttgattttcattttttattaagaaaaaattttattttacagaatttaccttctctgtatatatgtgcataaagtgtggtgtaaatatactaaacaaacttatatttcaataaaagggagtttaaaatttataa

SEQ ID NO: 135270 - DNA, 3538 bp, Homo sapiens
  Payload ID: 6433
  Gene Symbol: FOXL2NB
  Gene Name: FOXL2 neighbor
  Uniprot ID: Q6ZUU3
  ENST ID: ENST00000383165
  CDS Start-End: 132-659
actttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcagaatccccagccctggtgaagaagaggatgcctgatgcgtgcaccctgggaagggctggaatcggtctccccaagatgtgccttcacatggctgtccggcattcgaaggctcagaaaacagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccacttctctctccttctccctctgtcaactccaaatcccctctagttctccctcccctcctacttctctcacactcaccagctacacgtactaattcagattttgcacatgttggtggaaaacatgtcaagccaatgtgcagaccctaaggcttttcacacgctgctcactttcgcatctcacggtgcagaaggaccaatgggctccaggtttacaagcctgactccgagaagcctgttgattctctgatgtccttggcctgtgattcgggtgactgggctgccacctgggtgttttcatgatgggactgccgcacagaccacagagaagctcaggtactgagcacgttccagatacactttaacatgcacaggccactcacacaggctttatctctgtctcgaaactctgctgagtttgctgctcagaccaacaaggtgcagcagcagacacccacatagcaccaggtctgaagccagtgggtattagtctgcctggttgggattagcaaagtcagttactcacatatgtgcttgggagagaataggggagtggagagagagagagagatattgaggaagaggaaagagaagcgacctcctactctgggaagaactcacacatgagagctgtttcctgttgttaagtgtctcactgagctcccctctttctcccccaggaagggcttgagaggcagtagaccagagctctgggctcctctttaccttgctgatgttggggtatgagtcctccaacaccattttgtcccaaggagtatgtgccccatcgtcaatcaggcagaatgcagggcagttgtcggcctttttcatggtggaggccaactgggaaaaaggcagaagggtctgggtcctgggccaagtgaggccctcttccctccaaagacccgtgggatgctctcagaggcggattctagggtggtgggagctgctgacaagtttcctctgatatccctcatgacatctatggcccaaagccattttgttcagctctgaacagtgagtgccttgccagtaggcctcaggcttgctggggaacatgatgtgttcttaaaagttgccttgttgcctttctccacacccagactgtaagcgctgatgggcagagactctgccctccacttctcactcagtgctccccaccaggatgggcttaatgccttttaatagaattagaaaatggttctgctggacagaattgggaaatgccactttccttataatgaagttataatgaagttagaatttccaagaaagggactgtagctgaggaaaagcggtttgatcattgacagccagctcaggatctgagagttctttgccatttggggttattatagctgcatggccatggtgctgaaccttaggcaagggcaaggacacctccctagttcccagtcatggtgaggacctgtctgaaacattcaaactagactttactggaaacagagaagtctctgcattcagggcagctggcttgcaaggtaaggcctgcagtctccacccgcacgctaacccatgaggggatgccagagagagcccttcccccttggtcctcattcctggctcaattttctcccacaaagcgggcactttctaaagatgataggcaactgccatggaggaaggcagttttagatgcctagctggcacaaagtccagaggaagggagggagaagggctgagttttgtattactgttctacctttggagattttcctcatgccaagatagggtgtgtgtgtgtgtgtgtgtgtatgtgtgtgtgtatgtgtgcactataactttatgaaacactttttttttttttgagacagggtctcactctgttgcccaagctggagtgcagtggtgcaatcttggcttaccgcagtctccacctcccaggctcaagtgatcctcccatctcagcctcagcctcccaagtagctgggactatgggtgtgagccaacacactcagctaattttttttttttttttttggtatttttggtagagacagggttttaccatgtgggcccaactggtcttgagctcctgagctcagggtgatttgcctgcttcaacttcccaaagtgttgggattacaggtgtgagccaccatgcccagtcagttttttattttttatttaaacagttttgggggaacaggtggtttttgcttacatggataagttctttaatggtaatttctgagattttggtgcacttgtcacccgagcattgtacacggtacccagtgtgtaatcttttatccctcatccccctcctacgcttccccccccgagtccccattatataattctttttttcttctttttgagacagagtctcactctgttgcccaggctggagtgcagtggcatgaacttggcttactgcagcctcctgagttcaagtgattctcctgcctgaacctcctgtgtagctgggactacaggcatgcaccaccatgcccagctaatttttgtattttttgtagagatggggtttcaccatgttggccaggctagtcttgaactcctaacctcaagtgatctgcctattttggcctcccaaagtgttgggattacaggcgtgcgccactgcgcctggtccattatgtcattcttatgcctttgcatcttcatagcttagctcccacttataaatgaaaacacaggatatttggttttccatacttgagttacttcacttagtataatggtctccagctccatccaggttgctgtgaa

SEQ ID NO: 135271 - DNA, 974 bp, Homo sapiens
  Payload ID: 6433
  Gene Symbol: FOXL2NB
  Gene Name: FOXL2 neighbor
  ENST ID: ENST00000470680
  CDS Start-End: 132-257
actttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcagaggaacagaatccccagccctggtgaagaagaggatgcctgatgcgtgcaccctgggaagggctggaatcggtctccccaagatgtgccttcacatggctgtccggcattcgaaggctcagaaaacagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccacttctctctccttctccctctgtcaactccaaatcccctctagttctccctcccctcctacttctctcacactcaccagctacacgtactaattcagattttgcacatgttggtggaaaacatgtcaagccaatgtgcagaccctaaggcttttcacacgctgctcactttcgcatctc

SEQ ID NO: 135272 - DNA, 1681 bp, Homo sapiens
  Payload ID: 6434
  Gene Symbol:
  Gene Name: FP325317.1
  ENST ID: ENST00000539936
  CDS Start-End: 333-830
tggactggggacacagggatagctgagccccagctgggggtggaagctgagacagggacagtcacagaggaacaagatcaagatgcgctttaactgagaagcccccaaggcagaggctgagaatcagaagacatttcagcagacatctacaaatctgaaggacaaaacatggttcaagcatctgggcacaggcggtccacccgtggctccaaaatggtctcctggtccgtgatagcaaagatccaggaaatatggtgcgaggaagatgagaggaagatggagcgagagttcctggctgagttcatgagcacatatgtcatgatggagcccacatgaacgcagctgtgagcttcactaactgtgcactgggccgtgtgccctggaggaagtttccagtctatgtgctggggcagttcctgggctccttcctggcggctgccaccatctacagactcttctacatggccattctccacttttcgggtggagagctgatggtgaccggtcccgttgctacagctggcatttttgccacctaccttcctgatcacatgacattgtggcggggcttcctgaatgaggagtggctgaccgggatgctccagctgtgtctcttcgccatcacggaccgggagaaaaacccagcactgccaggaacacacgcgctggtgataggcatcctcgtggtcatcatcagggtgtcccatggcatgaacacaggatatgccatcaatccatcccgggacctgcccccccgcatcttcaccttcattgctggttggggcaaacaggtcttcaggtacttcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgagggtgctgtcctgggcatcagccccctcagctggcctctgcctcttgcctgcagcaatggggagaacttgtggtgggtgccagtggtggcaccacttctgggtgcctctctaggtggcatcatctacctggtcttcattggctccaccatcccacgggagccactgaaattggaggactctgtggcatatgaagaccatgggataactgtattgcccaagatgggatctcatgaacccatgatctctccccttaccctcatctctatgagccctgccaacagatcttcagtccaccctgccccacccttacatgaatccatggccctagagcacttctaagcagagattatttgtgatcccatcccttccccaataaagagaagcttgtcccacagcagtacccccacttcctgggggcctcctgtggttgggcttccctcctgggttcttccaggagctctagggctatgtcttagcccaaggtgtagaggtgaggcacctcaagtctttcatgccctgggaactggggtgccccagggggagaatggggaagaactgacctgcgccctcagtagga

SEQ ID NO: 135273 - DNA, 1195 bp, Homo sapiens
  Payload ID: 6435
  Gene Symbol: FPGT-TNNI3K
  Gene Name: FPGT-TNNI3K readthrough
  ENST ID: ENST00000370893
  CDS Start-End: 16-471
agggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttgggtaatggattggtgacaggaagaaatgaagaaaaagagaaggcaggaggagaaagaaagacagaaagggcaccttagagtaccattgtctgattatatcctcctctgtgctgcctctaatctttatcaacataacagcacttactacatggtgttgtttttatccatttataggtctatctccccactagtatatgtgttcattaaaggcagctttttttcttatttagccttatttatatttgtacttatttgtaaaacaaactaataacttagggcttaccatatgccagaaatgcttctacgtatctttttgtgcatcagcttatataatcctaatggtgtatatgtaaagtgctttagcacagtgtctggcacatggcaaaccctcaaaaatgttagttaacacttaatcattattgtttatgttaacaaccctctgaagtaagtgttgcaattgccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaa

SEQ ID NO: 135274 - DNA, 7566 bp, Homo sapiens
  Payload ID: 6435
  Gene Symbol: FPGT-TNNI3K
  Gene Name: FPGT-TNNI3K readthrough
  ENST ID: ENST00000370895
  CDS Start-End: 36-2129
gtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacaggtatttttttcctaaataatgaactcagaagggtatgactaactgggagtttaagacagatttcagtgaagatacattttagacttattgcagatcagggtactctgtggttaagaggacaggctaccataagcttaggcgatagaaagttttgtcattgtcttttaaggagtagaaagctgtataactgcttctcagggatcttttaaatctatgaagaatattcacaaatatagtaatatctgtaagatgcaccagctaactagttcccaggtcagtaaggtcacatcaagcagtgagctaaatggctattaaaaaaatgatatgtctcctataaagtgaagtgttggagtagctcctgatataaaattatctgaaacgtactttgtgctaccgtaaattcagcttaaccacaacagcttatttacctagttatcaggtaaagaggatttcatgtgaaacaaatataaaatcagagtgttccagtggtggaaccccaagtgacctcaaaacttttcctaaatagtgaaaactttctctgagtaaagtcttataggaaaggccaatatacaaaatggagcagtgttgggtgaaggtaaagtggggaggagaaaactctatttacttcccatttcccactgctaaggagagagattcctgcaccacctctgtggaagcccaaaggtgctgtagagaatagttggacaaacactgatttagtttatgaagcaagtcagattattccacatcaatcactttcattttatgatagtcaataagattcaaatagattgtgtatatagtcctttatagaagctttacagttctgaagctagtaaatattgattactctagtcagtcatttggtcaacaactatgtttgaacatatatgtttaaagactattttcagcacagtagagcttacaaagtgggacgttcatagactacattcagggagttttcacactctatgtagaggagaaaaatatttacctaaatgtatttgaggtataaaataataagttatatacaagatttagtacaaaaatttcaggaacaagaatattaattgcttctgaggattctaacaacaactctatggaagggatgacatatgagcttggtcctgaaagatgggtagtttggaagagcatcctataggcttagggaagacataataaaatgcatagagattagaaagttaaaggtatatataggaactatagtttcattttagtatacaaagtgtataaatgtatgtaatgtgtataatgtaagaagtggacaactggaaaaaggtatagaaaaatagaaaaagagcacagacaccagtgaatgctattactaaggtatttcagattttttttcctgtaaggagaccataaagaggtttgagctgaaaatcacaaatttggagctatattattgaaagatgaatccagcatctggtaaaatatcaacttgaagggaaagtcaagaaactagtgagggagttgttgcagtaatctagataagaagtaacgaaaagcagaatttcaccggtggcagtggatatgaaaggaagagacatgtcaactttaaataacaaaatacagagtttattcaagctcaaagcttgaggatcattacccatgagcatggactcaagttgtcctgaatacatactccaattagcagtggttacaagatagtttttaagaaaaaaaaaaaaaaaaaaaaaagcagtttttaagttgtttacaaagaatttacataaataatataaactattgattggttgtaccttgttctttaatcaaaaattataggaacataaagataatgggtaacacagctagtcaggaacaaaatacctttacactattgccccagggaaatggagattggagagatgactaaagtcccatgctcatgtctctctgggcctgataaattttgtgttgctcatacagctcagactgccctcagctatttttctcttctcagatagatatgaaagataggagagataaatcagatacgtgagtggtagaatcttaaatattgaaagtaaatgtaaataagtctcaatctatttataattatttactagttttcacataaaagtcatttcttaatttttagctattagttctttacctttcttaatttcaaaccaaacatttacgttaacaaacatttaactatttcagacacagatttagatgataaattagcataatataaaccgatgattttgagttttaagagtattatctttccatcccaaacatttttgcacatggtattaaaacaaatgagtaatcattgcaataagtaatcattgcaagttttctctagctgtaactcttcatttgtggggccattatatattctgttgccctgagttatgtgcaagttgttaccaccagttgtcaggcaggaccaaaaatataaatgttgattaaaataaaaacagaacatttactatatagctgatataagtttatatctacaatttttgctgcctctaatctaacctaaatgcttaattgcatcaaaaagtttttaaatcttatgaaacaccattttgtaggtgccttcattatgacagagtcccaaactattgtatcaattatttgtagactattttctatcaatctttaatctggtagcaacagcaaaacattgtttttcagatgcatgcatatgtagcattctacatggctcaaaagagcctgggtcctttccctcagagagcttactgcactacttggcaaataagacatatgcccagaaagcaactagagttccactttatatagaaaataattaagggtcaaaatgatgaaagagcaactttcagaggatttcaagtaagtcaaagatgaaagttgagtagaatgcttcttagcctatgtggagctaaacgtagagtttgaagaacaggcattaatcttttctcaggcttttcacagcatactaacctctgctttagcatggtacctagaaagtctcactcaaagaagtagagagaaagatgcacatcagagactgggaaactcatacacttatttgcatttgtattgacatggtgtgtttatatttttatattccccattagcctgggcaagtcagggtttcaggggcagagactgctctcttcatctcacattttctgaactaagcattgtgtcttacacagagaagatgtctaattaatattttttaactgaaccaaattattgtggatttctatgagtgtcatttcacgaagcaatgacctaattggtataagtatgactacttgtgtatagcatccaacttgcccaataacttttataattttaaagggaaaaggatgtttgagcccacgggatggggcacttttatatttgagtttgtggttgttgcaattgtttgagtgaaaaaaaagaactctacttttcccatggcaagcaaagccagctgagggtttgtaccatccagttctgaaagttaattttgatcttcagtaaatgtcccttggcatctgcaggggattggttccaggacctctcatggataccaaagtctgagaatgctcaagtccctggtattaattgctgtagcatttgcatatttcctatgcacatcctctcctgtactttaaatcattgaaagagtacctataatatctagtacaatgtaaatgctctgtaaatagtttttgcactatattgtctagggaataatgacaaaggaaaaagagtctatacatcttcagtacagacacaatctttaaaaaaattttttgatccatggttagttgaatccacagaagtgaaacctatggatttagagggccaactatatatactaaggaaaagttcaaggaaggagtaagaaagtagttattttcaatgtaaatgatgataatgataatacctaccatttatttatcaccatatgaaaggagctttgctaagtttttcatgctttcatttaaccacgcaactctatgggatagttgttattatttccattttacagataaggaaactgactaaagagactaagtctgtagtattctgtatcttctactgtaacaacaacaacagcaaaaccatgtgagaagagagagatagaaggagcgtactgatgatattgaatgggcatcagcaatatttatcagccttactctctgtactttaatcttttaaaaagtcaattcctgtgacccaaacaatttctcatatcatcttatgcttctgtgttcctgctttatttcttctttcacactccatgttctgctggtgtggaacagatgttgcatagaaagcatgcagataggttttgtttggcccatagtgtttaaatattttgaaaatgttcataattcaagcaggaatgtacctctctaatttgctgtagacctcaccacctaccaacttatatttggtctaatttatacattcattttgtggcattggagtttgctagtcattatttatagcttaaaggatttaaactttttacttaatactagaagctgtgtgtttttcttggaaaagtatatttttcaaattgtttgacactgaagcagaaacatcactgcaaacatacatggatcaaatacatgatattctccttctataaagatatagtattatatgttatattaacactgtaaggaattaaatagtgataacctccatcacaaagtgcacatggcattcacatgaaatatgtatatgaaatcattttataaactgtgaagcaccatacaaaatgcattttttattactcttaattcctcatttgttccctttaatattggggatggaaaaacactccacaattaaaaccacctttgcaaaaactacaactgagaaaattatgactgaaagatctgacttgactccactttgcttctaacctgcaagctgttcttgttcattcatggacataggccaaaataactttgggaggaacttgaaactaagacaataatagccctttcacaaaacaaacctctttcctgcctggggactacactaccttcataggactaacaaattagccacaagattagaaataatggtttaggaatcacatagctggagactgaaagattagaaacctccccagattgcttctggggataaatcactattgcaaaacctaagatcagtgcttgagatattttgcagatgctgtacaggatggctcagctgctaccacccagactgataaactgggtcatctggtctcctggccccaggagactgactcagcatcaagaggacaactttgacaccctatgatatcatctccaacccaaccaatcagcagtccccactttcagacccctacccaccaagttttccttaaaacccccatcctcaagtttttgagaagactgatttgagtaataataacactcttctctcctgtacagctggctgtgcgtgaattaaacttttctctattgcaa

SEQ ID NO: 135275 - DNA, 2752 bp, Homo sapiens
  Payload ID: 6435
  Gene Symbol: FPGT-TNNI3K
  Gene Name: FPGT-TNNI3K readthrough
  ENST ID: ENST00000370899
  CDS Start-End: 38-2569
gcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaagcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgttcactgctataacactaacatctaaagctggatgcttaagaatgtttgttgagtaaatgaatgaataccagta

SEQ ID NO: 135276 - DNA, 517 bp, Homo sapiens
  Payload ID: 6435
  Gene Symbol: FPGT-TNNI3K
  Gene Name: FPGT-TNNI3K readthrough
  ENST ID: ENST00000534632
  CDS Start-End: 31-517
gtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgggcatgatgccattgtcacactcctgaagcattataagagaccacaagatgaattgccctgtaatgaatattctcagcctggaggagatggctcctatgtgtctgttccatcacccttggggaagattaaaagcatgacaaaag

SEQ ID NO: 135277 - DNA, 2855 bp, Homo sapiens
  Payload ID: 6435
  Gene Symbol: FPGT-TNNI3K
  Gene Name: FPGT-TNNI3K readthrough
  ENST ID: ENST00000557284
  CDS Start-End: 6-2855
ggcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaaggtctgtctttggaggagatgaaaagaagtcttcaatacacacccattgacaaatatggctatgtatccgatcccatgagctcaatgcattttcattcttgccgaaatagtagcagctttgaggacagcagctga

SEQ ID NO: 135278 - DNA, 174 bp, Homo sapiens
  Payload ID: 6436
  Gene Symbol: FHIT
  Gene Name: fragile histidine triad
  ENST ID: ENST00000341848
  CDS Start-End: 1-174
gtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaag

SEQ ID NO: 135279 - DNA, 1634 bp, Homo sapiens
  Payload ID: 6436
  Gene Symbol: FHIT
  Gene Name: fragile histidine triad
  Uniprot ID: P49789
  ENST ID: ENST00000468189
  CDS Start-End: 372-815
gaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacaggtaaagactgcatttcgtcattacccagaccctcccgtgggcctcaggaaagaggctgcactctcagaatggggatgcacaaaaacaccttcaccagcatccttgggtggtggctgcaaaggacaaagagctggaggggagaaaaccctggcccttgagtactgtattcccagcctcccagtctcttccaactctcctgcctcttcactctcttcttccaagccagtgcccccagcccaccaccacctttctccagtctttcctgcggtggtgctcctccagaatccaatgttcacaaagcagaccttctgtcatgcacaacttcttgtttaaaaggtcaaccccaacttaacttaaaggtgtgacatggcccttaggctcaagtctgtctgcaaagccctgtaaaccagctttctctgcctccctaacacgcccccgggcaaactcctctgctttcactgagtggactcttctcttcagttgctatttggtaaattgcccttcatgtttccctttatgttcggctcctaggaagctcaggccacagggaaaagtcaaggcttgatagaattaatctttgtcttaatgatgactaactgttgagagatcataggtttaagactctggtagaaagatagctatagccaatttccttgtcaaaatgcttctactccaaatttttatgcagtgtctaacgagctcatgcctagatctatctggcaatctatattatccctcctagtctcagttcacatagtagactgctggaatgactgagggtgatgtttggcctgtaaacaaaaagtgttaaaga

SEQ ID NO: 135280 - DNA, 1033 bp, Homo sapiens
  Payload ID: 6436
  Gene Symbol: FHIT
  Gene Name: fragile histidine triad
  Uniprot ID: P49789
  ENST ID: ENST00000476844
  CDS Start-End: 326-769
cctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaa

SEQ ID NO: 135281 - DNA, 1081 bp, Homo sapiens
  Payload ID: 6436
  Gene Symbol: FHIT
  Gene Name: fragile histidine triad
  Uniprot ID: P49789
  ENST ID: ENST00000492590
  CDS Start-End: 363-806
tccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaa

SEQ ID NO: 135282 - DNA, 601 bp, Homo sapiens
  Payload ID: 6436
  Gene Symbol: FHIT
  Gene Name: fragile histidine triad
  ENST ID: ENST00000488467
  CDS Start-End: 366-601
cctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaaggtaccgtgactggatcacatggagccccaggatttttagtacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcac

SEQ ID NO: 135283 - DNA, 3089 bp, Homo sapiens
  Payload ID: 6437
  Gene Symbol: FRA10AC1
  Gene Name: fragile site, folic acid type, rare, fra(10)(q23.3) or fra(10)(q24.2) candidate 1
  Uniprot ID: Q70Z53
  ENST ID: ENST00000359204
  CDS Start-End: 199-1146
acccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacgctgtggagaatccagcaaaaggaaaaaaaggacagttgaagatgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatacaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctca

SEQ ID NO: 135284 - DNA, 4333 bp, Homo sapiens
  Payload ID: 6438
  Gene Symbol: FMR1
  Gene Name: fragile X mental retardation 1
  Uniprot ID: Q06787
  ENST ID: ENST00000218200
  CDS Start-End: 230-2065
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatg

SEQ ID NO: 135285 - DNA, 1295 bp, Homo sapiens
  Payload ID: 6438
  Gene Symbol: FMR1
  Gene Name: fragile X mental retardation 1
  ENST ID: ENST00000334557
  CDS Start-End: 129-1022
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagggttgaagatctgaacataggttacttaaatctaaaaagttccaaagctagaagaaacttcagatgtctctgggactttctgcaaagtcaatagtaattcttcattttgacttgagtagtgttttatcaccatcaccatcgtgagtatcagcaaatatttaggagctcttcaccaatactcctaaatgctgcagatatctttagtagaacatatcaaaaccaggtgcagttttatcaagaaagctacatatgtttttaatttgtaaataaaattgggacatactgcc

SEQ ID NO: 135286 - DNA, 1774 bp, Homo sapiens
  Payload ID: 6438
  Gene Symbol: FMR1
  Gene Name: fragile X mental retardation 1
  Uniprot ID: Q06787
  ENST ID: ENST00000370470
  CDS Start-End: 1-1773
atggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaa

SEQ ID NO: 135287 - DNA, 4125 bp, Homo sapiens
  Payload ID: 6438
  Gene Symbol: FMR1
  Gene Name: fragile X mental retardation 1
  ENST ID: ENST00000370471
  CDS Start-End: 230-1843
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatg

SEQ ID NO: 135288 - DNA, 4308 bp, Homo sapiens
  Payload ID: 6438
  Gene Symbol: FMR1
  Gene Name: fragile X mental retardation 1
  Uniprot ID: Q06787
  ENST ID: ENST00000370475
  CDS Start-End: 129-2027
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccagaaacctgaactcaaggcttggcagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaa

SEQ ID NO: 135289 - DNA, 3437 bp, Homo sapiens
  Payload ID: 6438
  Gene Symbol: FMR1
  Gene Name: fragile X mental retardation 1
  ENST ID: ENST00000370477
  CDS Start-End: 218-1966
gggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgca

SEQ ID NO: 135290 - DNA, 3699 bp, Homo sapiens
  Payload ID: 6438
  Gene Symbol: FMR1
  Gene Name: fragile X mental retardation 1
  ENST ID: ENST00000439526
  CDS Start-End: 129-1907
ggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgcta

SEQ ID NO: 135291 - DNA, 4271 bp, Homo sapiens
  Payload ID: 6438
  Gene Symbol: FMR1
  Gene Name: fragile X mental retardation 1
  Uniprot ID: Q06787
  ENST ID: ENST00000440235
  CDS Start-End: 230-1990
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaa

SEQ ID NO: 135292 - DNA, 1352 bp, Homo sapiens
  Payload ID: 6438
  Gene Symbol: FMR1
  Gene Name: fragile X mental retardation 1
  ENST ID: ENST00000621987
  CDS Start-End: 186-1079
ggccgcctctgagcgggcggcgggccgacggcgagcgcgggcggcggcggtgacggaggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagggttgaagatctgaacataggttacttaaatctaaaaagttccaaagctagaagaaacttcagatgtctctgggactttctgcaaagtcaatagtaattcttcattttgacttgagtagtgttttatcaccatcaccatcgtgagtatcagcaaatatttaggagctcttcaccaatactcctaaatgctgcagatatctttagtagaacatatcaaaaccaggtgcagttttatcaagaaagctacatatgtttttaatttgtaaataaaattgggacatactgcc

SEQ ID NO: 135293 - DNA, 1864 bp, Homo sapiens
  Payload ID: 6438
  Gene Symbol: FMR1
  Gene Name: fragile X mental retardation 1
  ENST ID: ENST00000621453
  CDS Start-End: 230-1864
acttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagagggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatacctccagtgaaggtagtcggctgcgcacgggtaaagatcgtaaccagaagaaagagaagccagacagcgtggatggtcagcaaccactcgtga

SEQ ID NO: 135294 - DNA, 571 bp, Homo sapiens
  Payload ID: 6438
  Gene Symbol: FMR1
  Gene Name: fragile X mental retardation 1
  ENST ID: ENST00000475038
  CDS Start-End: 1-307
gtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtagggttgaagatctgaacataggttacttaaatctaaaaagttccaaagctagaagaaacttcagatgtctctgggactttctgcaaagtcaatagtaattcttcattttgacttgagtagtgttttatcaccatcaccatcgcaaagtaataggaaaaaatggaaagctgattcaggagattgtggacaagtcaggagttgtgagggtgaggattgaggctgaaaatgagaaaaatgttccacaagaagaggaaattatgccaccaaattcccttcctt

SEQ ID NO: 135295 - DNA, 1409 bp, Homo sapiens
  Payload ID: 6438
  Gene Symbol: FMR1
  Gene Name: fragile X mental retardation 1
  ENST ID: ENST00000616614
  CDS Start-End: 225-455
cggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaagctgtctccatcgggtttctgtggtttaggagaccccaccatcccagtgcatgctgataacgtcatactgatcagcatccagctacccacagcaagaattgaccacctcgtgggatctaaaatttaaagggggaaaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccc

SEQ ID NO: 135296 - DNA, 470 bp, Homo sapiens
  Payload ID: 6438
  Gene Symbol: FMR1
  Gene Name: fragile X mental retardation 1
  ENST ID: ENST00000463120
  CDS Start-End: 1-360
gatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaagaagacatgataggattgtgagtttttctctaactttggatgcagtgagatgaccagtgtgttccagttaaagaagaagagtgttttaaaatcataaaccaaataaagaatcctacctta

SEQ ID NO: 135297 - DNA, 1648 bp, Homo sapiens
  Payload ID: 6438
  Gene Symbol: FMR1
  Gene Name: fragile X mental retardation 1
  ENST ID: ENST00000616382
  CDS Start-End: 63-1322
tcgagcgcccgcagcccacctctcgggggcgggctcccggcgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggca

SEQ ID NO: 135298 - DNA, 776 bp, Homo sapiens
  Payload ID: 6438
  Gene Symbol: FMR1
  Gene Name: fragile X mental retardation 1
  ENST ID: ENST00000495717
  CDS Start-End: 19-776
agcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaag

SEQ ID NO: 135299 - DNA, 1832 bp, Homo sapiens
  Payload ID: 6438
  Gene Symbol: FMR1
  Gene Name: fragile X mental retardation 1
  ENST ID: ENST00000621447
  CDS Start-End: 58-153
cgcccgcagcccacctctcgggggcgggctcccggcgctagcagggctgaagagaagatggaggagctggtggtggaagtgcggggctccaatggcgctttctacaagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagcgtctaaaaccattagcagcgctgctacttaaaaattgtgtgtgtgtgtttaagtttccaaagacctaaatatatgccatgaaacttcaggtaattaactgagagtatattattactagggcattttttttttaactgagcgaaaatatttttgtgcccctaagaacttgaccacatttcctttgaatttgtggtgttgcagtggactgaattgttgaggctttatataggcattcatgggtttactgtgctttttaaagttacaccattgcagatcaactaacacctttcagttttaaaaggaagatttacaaatttgatgtagcagtagtgcgtttgttggtatgtaggtgctgtataaattcatctataaattctcatttccttttgaatgtctataacctctttcaataatatcccaccttactacagtattttggcaatagaaggtgcgtgtggaaggaaggctggaaaatagctattagcagtgtccaacacaattcttaaatgtattgtagaatggcttgaatgtttcagacaggacacgtttggctataggaaaataaacaattgactttattctgtgtttaccaattttatgaagacatttggagatcagtatatttcataaatgagtaaagtatgtaaactgttccatactttgagcacaaagataaagccttttgctgtaaaaggaggcaaaaggtaaccccgcgtttatgttcttaacagtctcatgaatatgaaattgtttcagttgactctgcagtcaaaattttaatttcattgattttattgatccataatttcttctggtgagtttgcgtagaatcgttcacggtcctagattagtggttttggtcactagatttctggcactaataactataatacatatacatatatatgtgtgagtaacggctaatggttaggcaagattttgattgacctgtgatataaacttagattggatgccactaaagtttgcttatcacagagggcaagtagcacattatggccttgaagtacttattgttctcttccagcaacttatgatttgctccagtgattttgcttgcacactgactggaatataagaaatgccttctatttttgctattaattccctccttttttgttttgttttgtaacgaagttgtttaacttgaaggtgaatgaagaataggttggttgccccttagttccctgaggagaaatgttaatacttgaacaagtgtgtgtcagacaaattgctgttatgtttatttaattaagtttgatttctaagaaaatctcaaatggtctgcactgatggaagaacagtttctgtaacaaaaaagcttgaaatttttatatgacttataatactgctgtgagttttaaaagtaaagcaaaagtaaactgagttgcttgtccagtgggatggacaggaaagatgtgaaataaaaaccaatgaaaaatgaa

SEQ ID NO: 135300 - DNA, 1021 bp, Homo sapiens
  Payload ID: 6439
  Gene Symbol: FMR1NB
  Gene Name: fragile X mental retardation 1 neighbor
  Uniprot ID: Q8N0W7
  ENST ID: ENST00000370467
  CDS Start-End: 75-842
ggaagcttctgggccacggactgccggaccgttgggctgtgaggcagcgtctcagcgaggcggcacccggagccatgtcttcacataggaggaaagcgaaggggaggaataggagaagtcaccgtgccatgcgtgtggctcacttagagctggcaacttatgagttggcggcaactgagtcgaatcccgagagcagccatcctggatacgaggccgccatggctgacaggcctcagccaggatggcgggaatctctaaagatgcgggtcagcaaaccctttgggatgctcatgctctccatttggatcctgctgttcgtgtgctactacctgtcctactacctgtgctccgggtcctcatattttgtgcttgcaaatggacatatcctgcccaacagtgaaaatgctcatggccaatctctggaagaagattccgcattggaagctttgctgaattttttctttccaacaacttgcaatctgagggaaaatcaggtggcaaagccttgtaatgagctgcaagatcttagtgagagtgaatgtttgagacacaaatgctgtttttcatcatcggggaccacgagcttcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaacc

SEQ ID NO: 135301 - DNA, 562 bp, Homo sapiens
  Payload ID: 6439
  Gene Symbol: FMR1NB
  Gene Name: fragile X mental retardation 1 neighbor
  ENST ID: ENST00000489034
  CDS Start-End: 1-257
tcaaatgttttgctccatttagagatgtgcctaaacagatgatgcaaatgtttgggcttggtgcgatcagccttatcctggtatgtctgcccatttattgccgctctcttttctggaggagcgaaccggccgatgatttacaaaggcaggacaacagagttgtaacgggtttgaagaaacaaagaaggaagcgaaagaggaagtctgaaatgttacagaaagcagcaagaggacgtgaggaacatggtgacgagtagcaagagaccaaagtgtttgcttgagcaagtcctttaactttcttgggcttcatttcaccaatcttcagaatgagaaggttgatttgatgaataggaaaagtgatttatctcagaagaaaaaaaagaaaatctttatataagcattattttcccctcaagacaacagaaaccattcagagcagaggggactgtctcagccatgcaaacctcatggagcattttggaaagttaaaaattgattcttatttttgtcatgtttactttcaaacatgaaataaaattgagttctgttttcatgcatcaaa

SEQ ID NO: 135302 - DNA, 3277 bp, Homo sapiens
  Payload ID: 6440
  Gene Symbol: FXR1
  Gene Name: fragile X mental retardation, autosomal homolog 1
  Uniprot ID: P51114
  ENST ID: ENST00000305586
  CDS Start-End: 804-2414
aaagccggtgatgcagggtgcgcagggatcccacctggagagtcggggcggcacgttgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatt

SEQ ID NO: 135303 - DNA, 8711 bp, Homo sapiens
  Payload ID: 6440
  Gene Symbol: FXR1
  Gene Name: fragile X mental retardation, autosomal homolog 1
  Uniprot ID: P51114
  ENST ID: ENST00000357559
  CDS Start-End: 385-2250
atgccgatgcgccgggcaggctgtgcctgggcagttcattctgtggcagctggaggcactactcggccgccgcggtgcgaactgcgggcactgtggggcggagacctaggggcgggtcaacaaaggtcgggcgattgtgtctggaggcaaatccgacgtagacggcggcaggcggagcccaaagccggtgatgcagggtgcgcagggatcccacctggagagtcggggcggcacgttgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaatttttttaactttctactttttacaccaattgttgcaaaatagttggagctattaataggcttaggatagtatactttgctttttaaaaagcatttatacttgctcataaatagcattaaaatgtcagttggccatttaatcattttgtaatgaatcatctgaaatctttacacaagtttaggctgttagatgcataggtaattaataatacatgtgataattagcaaaaaaacctaacaaaattctaatcaaaggcaactttggaagacaatgggggatagaagggatgacaagcaatttttaaataataggccaatgatttgctttattcattctcaacttattttgaaggctctcatatcagtgaccaaaaatcagttattaaactttatgtatatattttagccagagcttaatttttatgaagataaagacatgaagtttaacaatggacaacagttagtacagctaattgtgaggtcaagtaattgttagacataggggaaggctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagttaaaaatgtacaatgtgccagttcagtatatataaccctagccctcaaattattctgattaaggttaaaatgtgctggtattacgtgctttttcctgaggccttctgattggttcttggtaacagaattttaaagtaaggtgtgagtagtgcaactcctgtcctttatatataaagatatcaagtaatttcatgtcctgatatttaaaaaaattacccacaaatgtgtttttttaaatcgatcaaagctagcaacaggttaaattgtctcagttctcttacataattgggttaaaaattataaggtattagaagaattttaattaatgccaaattggtaaatatggtgtaaaaaaaaaaaaaaagacttttcattttctcccacatagaatagtcagatatattaaacatcccttttccataaagatggtttcaatgggaatggaagaaacaaaatcttaaaagagtgagtatagctgaaccaattcttcattctagcaataaccacactaagttcattactttacaaatgactaaacccaatgtcttgtcctttaaaaaatataggtagtgcagaattgtgataaatacgcatttgtttttttagagagccccactccccaaagggtagccattaattcaggtagccttttaaatgtatttgagagggttccgtctttttggctgctatcctagttaggtgagatgttgctatgggaagaacttgccactatacactaaacagacacttaagcaaaagatgtattctggagcctggcacagtagcttatgtctttggttctagctactcaggagcctgaggtgggagcatcatttgaactcagttctgggccactgagaccctctttaaagagaaggaaaaaaaggtattctggaagatcttgtgcagttgcaacaatgtttcagcatatatatgtgaattcatatatgacacctgaacggaatcatgaagtaacagctgagattatatggtggcaaaaatgacctgcttttcctgaagctttgggaggcctaggattcttgctttaggcatcacctttgttaagccttaaagggggctacaacttgtgcaaaatggtgtctctggtaacacttcagaaataattggcaaaagtgtaataggaatacacaaatctttattttgaaataatcttgtattttaatgtggaattagaagcagcacatcaaactggtgagttcacagaaacttacctgagatgatgctgggttccattgctgttgtgctaagtcacgtatttttgtagctgctgttagctgtgtctagcgttttgtaacctaaggagggtcttatagaagttggtatgttaactaaatcttggactgggaaacagcaccatttgtatcctctgcaaacagatttacgcttttgaggctcaaaccaactagtgttctcatgggctgttgcctaaggacagataaacatggaaaacaggctatgtccagggacagatgattggtggttaagaattacagtaaaggaaaattacacctggattttcttctgtaaagtttcaaggaacttggatttgaactgtgaatctactgttttggcaaaaaatctcaaagaaaaggatgtttgttactgtctcagtcttcctgtctttgctacacgatttggatcccttacgctttttcgttaagaatatctgtctgctatagtgaatttgctagccccttatttttttttttaattttagttctttattagaacgtgtacttgaatggactgtagttgctcataacccatgttaatctctgatagtatttgggttttatttcaggagcttttgcaataaagcagtaactgcaatctgctaaagtcagactgttagcaagtggtgttaaaactgatttaagtccattacactgaacagtaggaaattaccacttttgtaaggctcaaaaatgatcaactattaacagtttcttatggttcagtctaattacaaatttttaaaaagtttatcagtgtatcatttcagattcatctgtatcttctgtaatattatttccagtactgaggtaaggtacacaaaaattcccctggaaaaactatattctagttttgtaagatgatttcccacagtccatttgcttatttcttcctttgataattcaaaaagatgctttaggtaatggtacagaattagaagctgctattttagctctattaactttttctctatggtttcaattttatccaaccagagagggctggcctagttggtatctttaaggcccttccagtagtaatttgagtctagtcacatgtcagaccctgagcaacacctaaccaaatgcccaagtattctcataaggagtatgctgaatttaagtggtgtttgttttacatatgtatccatcccagacattttcaactatgctgaatgcaatctataagatattccaaacaaggacaaagtaatttttcacaagtcttacagccccactattaagtatgctactaattagcttcttgaatttctttgtatttcagtgattgggatgttctttttttttgggaaagtttttttacccctttgtaccctcttaattggattaactgtaaaatgtacatattaattttctagttttagagaccattttcattaaaaatattttccaatagtttttctagataaacaatttatacttaattgttgcttggttgcttacatttcaacctctaggcttcctttttcagctaacttggctgtcttcaggttgtaaagaaaaatgtaaacatatatttgaaatttcattaactgaaactgctgtaaggtgttagcaaatgttaaccataacagattatcccatatcattggactgttctattattgggtcaggaataataggtgacacaggatagaagctcttcctatatatatcttgttgctaaggcagtagttggctctaagctgataaacagcacactgtacagcagtccaaaaactaaaaccagagcttaggtcattcaagttaactggtactcaaggttactcattccaggatactttacataaccaaaaacctaggagagcattctacattgtaattttttttttactttgtttacataaaatttacagggttttgtttttttaagcttagtctgttctttgacattgttgattcatgttctaaattttcatcagatttaacatgtttggaggttcttgtgcactcaatgtgaacctactacaagcttctgaactgcaaaaccttttttttaggtcactgtcaacagaaagatgccttatagaatttctcatgattgaaacagaactctgcattctaacctaaaacccctctaaccctttaaatgaagcattatgcctgcgtgaaattttatttttagacatttctgatactaggttttctttacgggggggcatacatattcagtatactgaatttatacagctttcagtgtggcaatatattaagaagctagttccctaatttttctcagttctcattggttttccatttaaatgtttccgtaagtactctcatcatttggaaaatacttgatggcaggagaacttgcttaaaactaaaggtggagaaagagttaacttccaggacaacccattatagctcacttcttaccaacaaagcagtttttatacagcaccttaggactcatttctaatgtcaacccagatggccagtaaaggcaagggaagaggctaagtgactcacaaaaatctctgatattgaggtctaatgtgaaggctatagataggaattccccacaaacttctaatgaggactaatatgaacagcaaattggagaagacaccaaggacctaattttagtttcactagccgtgggaccttagaaaaaagaccatttgctctggacttttgtttcccaagccataaaatgtggaagaatcttcacaatttcaagttggtcatgtatatttcccttttacagagaaagctgaagcctcgaggctcagatttacctggcttctgtttacctggcttctgcagaagtttaacttgtaacctacctctcattcccaaagtgtgtttaatcatgccgccttctttaaaatatatctggaagcaccaatgagtaaagacaaaggccccaagctagatctgtagagataagtactagactcacatctcagtactatcaaggaaaacatgcttaggttatcagaattgtgaaggccatagtacaaaaagttaagagaacggaactcaggatctgagaaagatcagccattctcagcatgttgccttggctgcttaaccttactaaacttccatttcctcacatgtaaaatgtacatcataataactagtctactgagataagggaagaatacttagcacagtgctagtacactgtaagtactcaaatgttacagatccaagtattttgtaagaaaataccagcaaaagataaaagtttttttatggatcgtatttgtatcaatcacctacatgatctagagccctcacatggataacatttaaatgttcagtttgcctaatagccttcaatgaaacacggattcttctacttaaaaaaggtaagcctggagaaaataaaactgattactatgcaagaaaaaaatgtgctctgctgtgctccttggtatttttaagtggtttccattgtcttaacacctgtcttaaaacgggtatgttgtttgcactgaaccctcaaaagtatttatacctattaagttaaatttccctttttagagttaatgcttcattgcctgtcggcatattatcactatctgtctttgaaaaattttcttttaagtctcaactatttcttcataaagctcttgttcagagaaacattttttgatttgtccaatggactgaaataaaaggttagtaaaccaaaa

SEQ ID NO: 135304 - DNA, 2651 bp, Homo sapiens
  Payload ID: 6440
  Gene Symbol: FXR1
  Gene Name: fragile X mental retardation, autosomal homolog 1
  Uniprot ID: P51114
  ENST ID: ENST00000445140
  CDS Start-End: 15-1634
tttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatt

SEQ ID NO: 135305 - DNA, 571 bp, Homo sapiens
  Payload ID: 6440
  Gene Symbol: FXR1
  Gene Name: fragile X mental retardation, autosomal homolog 1
  ENST ID: ENST00000484790
  CDS Start-End: 345-571
aaccctggacctggccactcttctctggcggaagcaggttccgtgcgggccctacagcagcatccaagcccctgtcctctcggcacctgagttcttgtttggcatccaggaagaattaggtcacccacacggattgaaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaatttttta

SEQ ID NO: 135306 - DNA, 562 bp, Homo sapiens
  Payload ID: 6440
  Gene Symbol: FXR1
  Gene Name: fragile X mental retardation, autosomal homolog 1
  ENST ID: ENST00000484042
  CDS Start-End: 110-562
tttagcgtagaagcaatttaattttaattagtttttttccaatttagaagataatacatggtcactgaggtaattttggaactcagcaaaaactagaagttgccttgagatgagagctgttaacattttagtgtatttctttggttttttttggtggtttttcaatgtacagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacat

SEQ ID NO: 135307 - DNA, 739 bp, Homo sapiens
  Payload ID: 6440
  Gene Symbol: FXR1
  Gene Name: fragile X mental retardation, autosomal homolog 1
  ENST ID: ENST00000482125
  CDS Start-End: 1-739
gtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagatgatagtgaaaaaaaaccccagcgacgcaatcgtagccgcaggcgtcgcttcaggggtcaggcagaagatagacagccagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatgg

SEQ ID NO: 135308 - DNA, 1996 bp, Homo sapiens
  Payload ID: 6440
  Gene Symbol: FXR1
  Gene Name: fragile X mental retardation, autosomal homolog 1
  ENST ID: ENST00000480918
  CDS Start-End: 84-1910
gtgtagtgttttgagtccggcttccatttagcgtagaagcaatttaattttaattagtttttttccaatttagaagataatacatggtcactgagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcg

SEQ ID NO: 135309 - DNA, 572 bp, Homo sapiens
  Payload ID: 6440
  Gene Symbol: FXR1
  Gene Name: fragile X mental retardation, autosomal homolog 1
  ENST ID: ENST00000465551
  CDS Start-End: 291-572
gaagtctacccaaggatccccagcgaaagggagccatagtccgaggctctggctgcctgcctgtttggagctttgatggcctcgagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaag

SEQ ID NO: 135310 - DNA, 365 bp, Homo sapiens
  Payload ID: 6440
  Gene Symbol: FXR1
  Gene Name: fragile X mental retardation, autosomal homolog 1
  ENST ID: ENST00000491674
  CDS Start-End: 149-208
tgagaccccaggggtgaagggcgggggatcccaatcccagccctgttttcccctcccctttccccgcctccttctcgcccctcccccctcctcccctctggttggaaagtttctagaatctcttcccagcggcctttgcggttccaacatggcggagctgacggtggaggttcgcggctctaacggggctttctacaaggccatttaagcacccgtctaaaaaaaaatgagtagatcttcatagtaaggtaggatctacaagacacaaactgaagagaaaagcgaagttcagaacaaattgtagcaaatgtttaacaatttaaaggagatttgtatattattaaaattacattttttcctgtgaa

SEQ ID NO: 135311 - DNA, 570 bp, Homo sapiens
  Payload ID: 6440
  Gene Symbol: FXR1
  Gene Name: fragile X mental retardation, autosomal homolog 1
  ENST ID: ENST00000469882
  CDS Start-End: 213-570
gaactggagagaatgaaccctggacctggccactcttctctggcggaagcaggttccgtgcgggccctacagcagcatccaagcccctgtcctctcggcacctgagttcttgtttggcatccaggaagaattaggtcacccacacggattgaaaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagagg

SEQ ID NO: 135312 - DNA, 824 bp, Homo sapiens
  Payload ID: 6440
  Gene Symbol: FXR1
  Gene Name: fragile X mental retardation, autosomal homolog 1
  ENST ID: ENST00000484958
  CDS Start-End: 454-824
catggcggagctgacggtggaggttcgcggctctaacggggctttctacaagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcattt

SEQ ID NO: 135313 - DNA, 1989 bp, Homo sapiens
  Payload ID: 6440
  Gene Symbol: FXR1
  Gene Name: fragile X mental retardation, autosomal homolog 1
  ENST ID: ENST00000468861
  CDS Start-End: 218-1582
ctttgcggttccaacatggcggagctgacggtggaggttcgcggctctaacggggctttctacaagttggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggct

SEQ ID NO: 135314 - DNA, 1768 bp, Homo sapiens
  Payload ID: 6440
  Gene Symbol: FXR1
  Gene Name: fragile X mental retardation, autosomal homolog 1
  ENST ID: ENST00000491062
  CDS Start-End: 16-1488
ctttgcggttccaacatggcggagctgacggtggaggttcgcggctctaacggggctttctacaaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaat

SEQ ID NO: 135315 - DNA, 2957 bp, Homo sapiens
  Payload ID: 6441
  Gene Symbol: FXR2
  Gene Name: fragile X mental retardation, autosomal homolog 2
  Uniprot ID: P51116
  ENST ID: ENST00000250113
  CDS Start-End: 336-2357
aggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 135316 - DNA, 565 bp, Homo sapiens
  Payload ID: 6441
  Gene Symbol: FXR2
  Gene Name: fragile X mental retardation, autosomal homolog 2
  ENST ID: ENST00000571597
  CDS Start-End: 211-565
gtggaggctgtggagcggcagcggcagcagcgggtcccgggactgaggcagcagcgggggcggcggcgggcggaagctgagggctttgtgaaggatgtccatgaagactctgtcaccatcttctttgaaaacaagtaagaccttgggaatagagaatccagcatactaggtcctagaaggagagtggagaagagggggcagctgagtcctatgagctggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaaga

SEQ ID NO: 135317 - DNA, 6126 bp, Homo sapiens
  Payload ID: 6442
  Gene Symbol: FREM1
  Gene Name: FRAS1 related extracellular matrix 1
  ENST ID: ENST00000380875
  CDS Start-End: 817-4824
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaa

SEQ ID NO: 135318 - DNA, 7324 bp, Homo sapiens
  Payload ID: 6442
  Gene Symbol: FREM1
  Gene Name: FRAS1 related extracellular matrix 1
  Uniprot ID: Q5H8C1
  ENST ID: ENST00000380880
  CDS Start-End: 785-7324
ttagtacaaaactagtagtgagaaaggaagctgggaagagactgggaagaggcaaccgacctcattaacaaaagctcagttttgtccctgcggacccaaccagcagaaggcacggggctagcggtggctgtccgccagggaggtcgggctctgtgtaaacagtagaaggcatctttatcatgcccttctcacagggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaa

SEQ ID NO: 135319 - DNA, 2481 bp, Homo sapiens
  Payload ID: 6442
  Gene Symbol: FREM1
  Gene Name: FRAS1 related extracellular matrix 1
  Uniprot ID: Q5H8C1
  ENST ID: ENST00000380894
  CDS Start-End: 90-2237
agtctgcagggaggaaagtcagaattagatattcaagatggccgcctctgatggagtccctggcactcactcaagcttgcatttggtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaa

SEQ ID NO: 135320 - DNA, 1421 bp, Homo sapiens
  Payload ID: 6442
  Gene Symbol: FREM1
  Gene Name: FRAS1 related extracellular matrix 1
  Uniprot ID: Q5H8C1
  ENST ID: ENST00000427623
  CDS Start-End: 2-670
gatgctggatgagtccttggcagtcaggaggtccaaaaaatgcaaagaaatgataatgcactgggagaagaaagaagatattgacatcgtgaacacagtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctgg

SEQ ID NO: 135321 - DNA, 10086 bp, Homo sapiens
  Payload ID: 6442
  Gene Symbol: FREM1
  Gene Name: FRAS1 related extracellular matrix 1
  Uniprot ID: Q5H8C1
  ENST ID: ENST00000422223
  CDS Start-End: 817-7356
acacaaaaagccttacaaatggaagaactaaggtggtacttaaaaacagcaccttaggatctagttccatcctatcttttcccttaaatgccatgacaaaagttaaaacgggccctgtcccttctgaatgctgggcttctcatctaaatttaaataaaaacctttgaagatgggaatgtgttggaagaaaagaagggcagaaaaaaagtgtgttggaagagtctgtggagtcctgaggcttggcgctcaggaagtttgcaaagctgcagcagctgccttggagaagaccagcaaagaaagtggagtgtgtatgtgaacttcaattctgtattttctgtgaggtgggttaatggatttttagtaaaaagaaatctcaaacacagctgacctgaaagactggaatttcagctctcttccttcccggggttctttttcctcccccttcctctcaaagccctttaaaccagattgctgtgtcagtgactcttatcctgcccgccagttccaagggtttctaactttttgtcttggaaaggaaaaccactacctgattagaaaagcacttgggaagcccattaatcttgccggcgttgtcaggagtgatcagcgagttttattaaaagccctgggattgcctgaaaggcccccttgtctgactttgaaatgaaaggggcatgttaagatctcggggcacattgtcaggacccctcaccctgccccttggactatgagctgaccctccaggaggaagcacagaagccctcctttgttaaagggatttcgccggtggacagagaagagttgggccctgtcagcatgaactctctgagttggggggctgcgaatgccgtgctgctgctgctcctcctggcctgggccagccccaccttcatcagcatcaaccgcggggtgagggtgatgaagggccactctgccttcctgtcaggagatgacctgaagtttgccatccctaaagagaaagatgcctgcaaagtggaagttgtgatgaatgagccaataacccagagggttgggaaactcactccacaggtctttgactgccatttccttcccaacgaagtcaagtatgttcacaatggttgtccaattcttgatgaagacacagtgaagctcagactttacagatttactgaaagagataccttcatagaaacttttatcctgtgggtctatctcctggaaccagactgtaacatcatccatatgagtaacaatgtgctggaggtgcctgaattcaatggcttgtcccaagcgattgataaaaatctgctcagattcgattatgataggatggctagcctggaatgtaccgtcagcctggacactgcgagaactcggctgccagcccatggccagatggttctcggggagcctcgaccagaagaacctcgtggagatcagccacacagttttttcccagagtcccaactgagagcaaaactgaagtgtccaggtgggagctgtaccccaggattaaagaaaataggaagcctcaaagtgagctgtgaggagttcctgctgatgggccttcgttatcagcatctggatcccccttcacccaacattgattatatctccatccaactggacctcacagataccaggagcaaaattgtgtacaagtcagagagtgcgtggctgcctgtctatatcagagctggaattccgaatcagattccaaaggctgcattcatggccgtgtttattctggaagtggatcagttcatcctgacctccttgactacatcagttctggactgtgaagaagatgagacccctaaacccttgctggtgttcaacattactaaagccccgctccagggctatgtgactcacctgttggatcacaccagaccaatctcctcattcacctggaaagatctcagtgacatgcagatcgcctatcagccaccaaacagcagccattctgagaggagacatgatgaggtagaattggaggtatacgacttcttctttgaaaggagtgcacctatgacagtccacatctccatcagaacagcagatacaaatgccccccgtgtatcctggaatacaggtctgagtctccttgaggggcagtctcgagccatcacttgggaacagtttcaggttgtcgacaatgacgacattggtgctgtccggctagtcaccgttggtggcctgcagcatggatggctgactttaagaggggggaaagggtttctcttcaccgtggctgacctccaggctggagttgttcgctatcatcatgatgacagcgactccaccaaagacttcgtggtcttccggatatttgatggccatcacagcatccgtcacaaattccccatcaacgtcttgcccaaagatgatagtcccccgttcctcataaccaatgttgtgattgaactggaggaggggcagaccatcctgatccagggatccatgctgcgagcttcagatgtggacgccagtgatgactacatcttcttcaatatcacaaagcctccacaggctggggagatcatgaagaagccagggccaggactgataggctatcctgtccatggcttccttcagagggatttgtttaatggaatcatttattatcgtcattttggtggagaaatctttgaagattcttttcaatttgtcctgtgggacagccatgaacctccaaatctttcagtgccacaggtggcaacaatccatataactccagtggatgaccagcttccaaaagaggctcctggagtttctcggcatttggttgtcaaggaaactgaggtggcctatataactaagaaacagctacattttatagattcagaatcatatgacagggagctggtctacacaataactactcctccatttttctccttcagccacagacacttggatgctgggaaattatttatggtggacagcataccaaaagtagttaagaatcctacggccctggagctgaggtcattcactcagcatgctgtgaactatatgaaagtggcctacatgccccccatgcaagacattggtccccattgcagagatgtccagttcacattttctgtcagtaaccaacatggcggtactttgcatgggatctgctttaacattacaatcctcccagtggacaatcaagttcctgaggcgttcaccaaccctctgaaagtgactgagggaggtcaaagcatcatcagcacagagcacattctaatttctgatgcagataccaagctggacaatattgacctctccctgcgggaattgcctctgcacggaagggtggagctgaatggatttcctctaaattcagggggcacattttcttggggcgatctccataccttaaaagttaggtatcaacatgatggaactgaagttcttcaggatgacctactcttggaggtcaccgatggcacaaattcagcagaatttgtactacatgttgaggtattccctgtcaacgatgagccaccagtcttaaaggctgacctcatgcctgtcatgaattgctcagagggaggagaggtggtcatcacctctgaatacatttttgctactgatgtggacagcgataacttgaagttgatgtttgtgattgctcgcgaacctcagcatggggtggtgaggagagctggagtcacagtggatcagttctctcagagagatgttatctcagaggccgtgacatacaaacacacaggtggcgagattggcctgatgccttgttttgacaccattacattggtggtttcggatggagaggctggcccttttgtgaatggctgttgctacaatggacccaatccatctgttccacttcatgcgtcctttccagtgtatgatctcaacatcacggtatacccagtagacaaccagccaccttccattgcaataggtcccgtgtttgttgtagatgagggctgctcaacagcccttactgttaaccatttgtccgccactgaccctgacactgcagcagatgacttggaatttgttttggtttctcctcctcagtttggctacctcgaaaatatactcccttctgtgggttttgaaaaaagcaatattggcataagtatagattcatttcagtggaaagacatgaacgcttttcacattaactatgtgcagtccaggcatctgaggatagaaccaactgccgaccagttcacggtgtacgtcacagatgggaagcatcactccttggagataccattttctattataatcaaccccacaaatgatgaagctcctgactttgtagtgcagaatattactgtgtgtgagggtcagatgaaagagctggactcttccatcatcagcgctgtggacctggacattccccaggatgccctgctgttcagcatcactcaaaagccacgccatggcctcctcatcgatagggggtttagcaaagacttctctgagaataagcagccagccaaccctcaccagaaacatgcacctgttcacagcttttccatggaactcctcaagactggaatgaggttgacgtacatgcatgatgactcagagagccttgctgatgattttacaatccaattgtcagatgggaaacataagatacttaaaaccatttcagtagaggtcatcccagttaatgatgaaaaaccaatgctgagcaagaaggctgaaattgcaatgaatatgggtgaaactcgtattatttccagtgctattctttcagccatagatgaagactcacccagggagaagatttactatgtatttgaaaggcttccccaaaatgggcaacttcagcttaagatagggagggactgggttcctctctcccctggcatgaaatgcactcaggaggaagtggatctgaacttgctgagatacacacacaccggggcaatggattcccagaatcaagatagcttcaccttctacctttgggatggcaacaacaggtcccctgctcttgactgtcaaatcaccatcaaggacatggaaaaaggtgatattgtcatccttacaaaaccactcgtggtgtctaaaggtgatagaggtttcttaacaaccaccacgctcctggctgtggacggaacagacaagcctgaggaactgctctatgtcatcacctcccctccgcgatatggccagatcgaatatgttcactatcctggagttcccattacaaacttcagccaaatggatgtagtggggcagacagtttgctatgtacacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagatgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaaaagctgcagtgaaaattttggactcaaaaggaggacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctcaacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattataaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttcattaaaccaaagttgaaccgcaaagttgtccctttggagccctttaaatgtgaaatctaagattagaggctggggttgaaaaagagaattttctatgatgaaaaagaaagactttagatgaaagaatcttgtaggtggaggctcatctacaaagctgtagttcaggtaagaattcggggggctggctgtactcagagttctactcatcactattcatgaaacagatctccctttccaatttgagtgttggcattgtaccatcccaaagctaatgattgggtttccccagccttacagagtcatgagaaatttcaagtaacataatctgttcctctgtgtttattgtactgacaagcatttctcagggacacttgggataaggagtatatatgaatgatggttgacacatggaagaaaaatactgcttcctcagaaatgtcctgatgaactgtgctgatgaacagagaaaaataataccgaaaacagagcccctgaaagcctacattctcggaaaggattttgaggaattttgagccaccttaaatctttaatatttgcagaaatgccatgttaactagattctctaacggaaaggtaccttattaatttataatctcaggtgagtggaacatttttgtaacaatgaagtatgttgcagcgttaccagaactcccttctgaaatcaaggtttaacagttataggaaattagaatgtctgaaacatttatttaaagtttttctcttttcataatcactgagaaatatggttgtgccaaatgtcacttgctctatgagcaccaatgtaacttcagaatcaaattggggttatcaagtaggctagagctctggtgctggttttattataaaaataccttgagtgttgtagacactaaaactgcttgaagaaagtcagttcagtttctgggatataaaaacatggcaagctttttttatttcagttcatttatcaaggttgtaattaatagaaacatttagaaagagatattggaatatgatccagacattctgtctattacttaaatctaaacataattatagtgtcagagggtccttacctgagatgtcgcaggtgggctccagattggcataatgtacaggttctctgtgagacacaagcagtttctggcatttaaccaaaagatgccacacctatcctcttaccagctcctttcaaattccttctggtccacaggcttcttgcagtatggaaatgtgagatttgggctaaagaaaaaatagttgtttacctaaagggttaagtcctaggaaggaagtagaagtttgggaaatgagggattcaagggccactccttccactggaactctaaaactatataaaccatctaaaactggaaatctagaactatgtcaactgtgtagaaccttgtcagcatggcagatttattatacatttctgcaatataaatgataaatgatactgaactaattgcaaatgttagcataaagagtgttttgatttttataacaattagaaatgctacaagaatatttaaaaatattcctgatcatgaaagcattaatcaaattagaaaatccaagtcattttaagaagataaaaatagaaattcaggcaagtttgggtgatgggcggtattcatcacaaccttcattttattcttacaattgagctttgactcagggggaaaagaagtaaatgattgtcaaggttccctctgccttgattgatagtttctgatgggagtgggaaggaaggaattggagtaatgggtagaatgggaatgagagattacgggagagagagatgagatgggttgaacagaagaggatgggaactgatggtagctaggaaggaaagcgtcaagaaggacctgaatgtacccagcttttctccccaaacttcaataccacctcaggaaaaggcccactgtgtccaggggcgtcagtccagctcaatagtgtctagcttttcagaatcttctgattgtttggtctttaacaaaaacatagcatctatttgctaacaataaacttaagcaacatatgataatcatttcatctccttccaagaagtggtgaaaatgaaccaggtgacattaatttaacttctgtttttgtttatttttaatacaaccaaaaagatatgcacatattttaatttacattatggtactgtataatttaaaccataaactggtgctgattaatttctgcaacaaagcagcatattaaatgtactacatctagtgttgtagcaaaattaataaacttgttttaagttctgagacactttc

SEQ ID NO: 135322 - DNA, 6729 bp, Homo sapiens
  Payload ID: 6443
  Gene Symbol: FREM3
  Gene Name: FRAS1 related extracellular matrix 3
  Uniprot ID: P0C091
  ENST ID: ENST00000329798
  CDS Start-End: 1-6420
atggcgggggcttctcggcacccgactgggacgccccggcagctccttgtggcgctcgcctgcctgctcttgagtcgccccgcgctgcagggacgggcatcctcacttgggaccgagcccgacccggcgctttacctgcccgcccggggtgcgcttgacggcactcgccccgacggccccagcgtgctgattgccaaccctggactccgggtgcccctgggtcgttccctttggctcgacccgctccgggatctggtgattggagtgcagccgggggaccggtgcgaagtcacggtactggacgccctgccgcggctcaagggcgcgctctccccgcgccgcttcccctgcaccttcgggccccgccaagtccagtacactcacttcggctcccacagccccggacgcgcccgggtgctgctgcagctgcgctacgacgccccgactcacactctggtgctgcccttcacgctggcggtggacttggtcttctcccagctggagctggtgacgcgtaacaggcctttggtagtggagaagctgcgaagctggagccgcgccatagacaggagagtgctggacttcgcctccctgaagtctggagccacggccacccgcaggtgccggcttaccccacttcctcacgaggacggccccctgcccaagtacgggcgcttggtggacgcggtgggggcccctctccccaggggcaagggcgtagactgtgaggctttcctccgtgctggggtgcgctatcagcacacagccacctcctcgcccaaccgtgactacgtgcccatgatggtggagctgctggggcctgagggccaagacgctgggtccgcgggtgtgctggtccgcgagcacttccagctgctcgtgaggatccgcggcggagccgagaacacaccgcccaggcccagcttcatggccacgatgatgatggaggtggatccactggtgctgacagccctgacgcctgacgcactggccgcggaggacgtcgagtcagaccctggtgacctggtgttcaacattctgaacgcccccactcacccaccagggcacccggggcaacagggctacgtggtcagcaccgacgaccctctagggcttccagtctccttcttcacccagcaggagctgagggagctgaagattgcctatcagccccctgcagagaactcccatggggagcgcctctttcagctggagctggaggtggtggacggagacggcgccgcctcagacccctttgccttcatggtgacagtgaaatccatgaatactctggtcccagtggctagccataacaggggacttgtgctttttgaaggtcagtcaaggcccttgtccagcacccacagcattcctatcagtgataaagataacctggaagaggtgaaaatggctgcagtcaggggcttgagacatgggcagctggtggtgtttggggcacctgctgggtgcaagtatttcacaccagcggacctggcagcagggcgagtggtgtatcagcatgatggcagcaacacctacagtgacaatatcatcttccggatggaggacgggcaccaccaagtggacttcctctttcccctcaccatcctacctgtggatgatgaaccaccaatggtcaatactaacacaggactctcactcactgaagggcaggtggtccagatctctccctttgtactgagtgctactgatattgactctgaggactcaaccatccactttgtgctggagaaccagcccctaaaaggaaatgaggaagagcctcagtgggagttggcccctggttcctcccactcaggccactacctgggggacctgttgctgcagcaggctgaactacctctctcaactgaagatgaagactggcactacatggaaaaggaagggctttatgagaaagtggtgactgagtggctacagagagacataatggaagggagactcttctaccgccatcttggaccacacagccctcaatctgtaatggtccagctggctttccatgtgcaggatgaccatgacccacccaatctctccaaacagcacattttcaccatcaaggtccaaccagtggatatactgagtccacagctgtatccaggaactacactagaaatgactgtacaagaataccaactcactcacttccagaagaatttcctccgatacattgaccaggactctgatgaccagaacctatggtacaccctactgacactcccgactgacacagatggcaaccaccaagtccgggctggagaaattgtgctcactgattcaccagacacactcatcatgcactttacccaagcccaggtaaatcagcataaagttgcctaccagcctccacagaaattgggtattgcaccacgggttgtgcagtttacttaccaggtggaagatgctgcaggcaatagcgtgccaggcacattcacattattcctgcaacctgtggacaaccagcccccagaagtcaccaacagaggctttgctatcttagagggaggcagctttaacctcagcagtaatgagctgcatgttacagacccagacacagacattgaccaaattgtcttcatattagtccggggtccccaacatggacacttgcagtactttaaaagatgtatggtcccaggggaatctttcatgcaagctgatgttattaacgggagtgtctcttaccagcatggcagagaccagacgactaccagtgacactttccatctggaagtaagtgatggggtgcaccatatacccatcaccatcccaatttctgtgcatcccaatgtggctaacagaagtcctaggatctctctcagaagtagttcattattggatgtttctatagacgtactagagaataaagccactgaaattaccatgggtgtcatccatggcaaaaggaaggatgtaggtgacttgatgctgtctttcattgtaaaggacagccccaaactgggcactattctggtaaatggtttgcccacagaacgattcacccaagaggatctcatcaatgggagagtagcctatgcccacactgcaggtgaagttggttttcaaaagcagcacgatgccttcagcctcatcctctccaaagattcttaccaatgggtagtggggaatagcataatagagaaagtacaggtacaagtaactgtgctgcctgtggacaatgtgggacccaaggtcttcgtcggggagtccttcattgtctatgaaggtgagaagaactccttgaccttacaacatctccatgttgaagatgtggacactcatcaagatgaactcctctgcacagtgactagtcagccagcctctggctacctggaaaagattgcatcagctcctggttcaaaaatgtcccagtctggtagccctatcagtgctttctccctcagagatatccaagtgaggcatatcaattatgtacagagtattcacaagggagtagagccacaagaggaccaattcaccttttattgctctgatggcatcaacttctccccaaatgtcttcttccctataatcatcctacccaccaatgatgagcagcctaaactttttgcccatgagtttaaggtactagaggggatgagcctggtcatagacacccagctgcttaatggagcagatgctgacctgccaccaaatgagctccactttcaactcacagccctccctcggcatggacgaatcatacagcagctggctacaggcagccagcccatccacagcttcaccctcaaggagatccaggaggcctccaccattgtgtatgagcatgatgactcagagacaaaagaggacagttttgaggtctggctgagtgacggcaagcacacaacccacaggaaggtacccattgtagtgaccctagtggatgatgaaactcctcacctgactgtcaacaatgggctgaaggtagagaaaggacactctgagatcatcacaaatcggatcctcaaggccacagatcttgactcagatgataaaagcctcagttttgtcctccattctgggcctcaacaagggcttctacagaggctgagaaaacccagaggagaagtgaggaacaatcttactctgggaatgaactttacccaggatgagattaacagaggcctcatctgctatatccacacaggccaagaagggattgttgacattatcaagtttgatgttactgatggggttaacactttgacagaccactacttctatgtcaccattggcaacttagacagcgtcttccctgaggtaatcagcaaaaggatcaccttgatagaaggtgccagagtgacccttaccaacaatctgcttaccaacagtgacatcaacagctctgatgaacatcactttagcattacacgggctccaagcctgggtcacttagaaagttctgactatgctggggaacccattgcctctttcactcaacttcaattggctagcaacaaaatatcctatgtccatacttcaaatgatgagaaaaagatggacagcttcgaatttcaagtgatcggcgaactctaccctgtgttcagaaccttcaggatcttcatcactgatgtggataataagaaacctatcttgaccatccatagactaacactacagaaagaggatagccaactgatcactctccttgagttgacagtggaagacagtgataccccagatgaccttattctctttaccatcacccaggtccccatgcatggcaagattttgtacaatggtagccgtcccgtgaccactttcaccaagcaagacctgaacaagaacctgattagctacaagcatgacggcagtgagaccactgaagatagtttctccttgactgtgacagacggcactcacactgatttctatgtcctaccagacactgccctggcgacacacaaacctcaagtaatgagggtccagataagatcattagacaataggcttccccagattactaccaacaggggtgccccagccttgaagcgccttcacactggacacatgggcttcctgattaccagcaagtctctgaaggcagaagatcaggacagtccccacaggcttctgaagtataaagtgaccagaggaccagagcatggcttcattatcaaaactggccttggaaaccagagcactcgagtgtttacacaagctgacattgatgagatgaagatatcctatgtcttgaatgagggcagcaacgcatcaaaggacatcttctatttctctgttgaagacaatggaggaaataaactaacaaatcagcctttccatctaaactgggcttggatttgtttggagaaagagtactacattgtggatgaagattccacattcttagaagtgacccttacacgcagaggataccttggagaaacatcatttatcagcattggtaccaaagatgaaactgcaaaaaaagacaaagatttcaaatggaagaccaataaacagatccagttcaatcctggacagactacagccacatggagggtgagaattatacctgacaatgaatatgagacttcagagaccttccagatcattctgtctgaacctctcatggctgtactggagtttccagaaatggcaacggttgaaattgtagaccctggagatgaatcaacagtttatattccagaggcggaatacaaaatagaagaggacattggggaacttttgattccagtaagacgatctggagatgcaagccaggaactaatcgtcatttgctccacacgtcaaggttctgccacaggcacgatttcttccacagtgttattctctgattacatctcacgtccagaagaccacaccagcatcctccactttgacaagaatgagacacagaagacctgccaggtcctgatcattgatgactccctttatgaagaggaggaatccttcagcgtttcacttaggctgccagtgggaggacagctgggagccagattccccaccactaaggtgactattctggctgatcgttatgatgaacctgtcctgcactttggggatgctgaatatcacgtcaatgaaagtgctcgctacgtggaggtttgtgtttggagaagaggcactgatctttcccaaccatcatccatcgccgtgcgctccagaaagtcagagcaggagtcagcagaagctggaacagattatgttggtatcagccgaaacctggactttgctccaggcgtgcgcatgcagacattccaagtgaccatccttgatgacctgggacagcctaccttggaaggcccagagaagtttgaattacttcttcagatgcctatgggtgcagtgcttggagaaccaaataaaactaccattttcatcgaggacaccatcacggactgtaagcagagtgcttgtagttcctttgattgaaagactttaagagggaaaaaaacagccaagatatgtctcctaacaacagaatgaaactctactgtttatagatcttagcaattctgggatatcagtgatattgtactgtcattggtgttatattctggtgatatgtggaaatgtaatttatatgactgcatggagatagaaatatatatacctagaaaacattgagcccacaaataattagactgtgttcatgttctttttctattttgttttactttgtttctgaggcaagtaagaaatccactgtgatcaattaaatcaaaagttaagatcaaagaa

SEQ ID NO: 135323 - DNA, 16070 bp, Homo sapiens
  Payload ID: 6444
  Gene Symbol: FREM2
  Gene Name: FRAS1 related extracellular matrix protein 2
  Uniprot ID: Q5SZK8
  ENST ID: ENST00000280481
  CDS Start-End: 217-9726
ggacggcctgggaaggcttcggctcctcggctgcggctccagcccggacggcgccgcgcaactttgccatccttctggcccagccccggctacaggaggaccccgcgggcaacgcgcggagttcctggcacttcccggcggtgtctcttgttgtctgcccggggaccgacttcgcatgctctcaggctgacctgtccaagcccgaacaccgggaccatgcactcagccgggactcccgggttatcctcgcgccggacaggcaactccaccagctttcaaccaggaccgccaccgccgccccggctgctgctgctgctgctgcttctcctgtcactggtaagccgcgtcccggcacagcccgctgccttcggcagggcgttgctgtcccctggtctcgcgggggctgcaggggtccctgctgaggaggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagggactggatacccatggtggtggagctgcgttcacgaggggctcctgtgggcagccctgctttgaaacgcgagcacttccaggttctggtgaggatccgaggaggggccgagaacactgcacccaagcccagtttcgtggccatgatgatgatggaggtggaccagtttgtactgacggccctgaccccagacatgctggcagccgaggatgctgagtctccctctgacctgttgatcttcaaccttacttctccattccagcctggccagggctacttggtgagcaccgatgatcgcagcctgcccctttcctccttcactcagagggatctgcggctcctgaagattgcctaccagcccccttctgaagactctgaccaggagcgcctctttgaactggaattggaggtagtggatctagaaggagcagcttcagacccttttgccttcatggtagtggtgaagcccatgaacacaatggctccggtggtcacccggaataccggtcttattctctatgagggtcagtctcggcccctcacaggccctgcaggcagtggtccgcaaaacttggtcatcagcgatgaggatgacctagaagcagtgcggctagaggtggtggctgggctccggcatggtcaccttgtcattctgggtgcttccagtggcagctctgctcccaagagctttacagtggctgagctggcagccggccaggtggtctaccagcatgatgacagagacggctcgctgagcgacaacctggtgcttcgcatggtggatggaggaggcaggcaccaggtacagtttctgttccccatcaccttagtgcctgtggatgaccagccacctgttctcaatgccaacacggggctgacactggcagagggtgaaacagtgcccatcctgcccctttccctgagtgcaactgacatggattcagatgattctctgctgctttttgtgctggagtcacccttcttaactacggggcatctgcttctccgccaaactcaccctccccatgagaagcaggaacttctcagaggcctttggaggaaggagggggcattttatgagcgaacagtgacagagtggcagcagcaggacataacagagggcaggctgttctatagacactctgggccccatagtcctgggccagtcacagaccagttcacatttagagtccaggataaccatgaccctcctaatcagtccgggctacagcggtttgtgattcgtatccatcctgtggatcgcctccctccggagctgggcagtggctgtccccttcgtatggtggtacaggaatcccagctcacaccactgaggaagaagtggctgcgctacactgacctggacacagatgaccgagaactacgttacacagtgactcagccccccacagacacagacgaaaatcacctgccagccccactgggtaccttggtcttgactgacaacccctcagtcgtggtgacccattttacccaagcccagatcaaccatcataaaattgcttacagacccccgggtcaagaactgggcgtggctactcgagtggcccagttccagttccaggtggaagaccgagctgggaatgtggctccaggtacctttaccctttacttgcatcccgtggacaaccagccacctgagatcctcaacaccggcttcactattcaggagaagggtcaccacatcctgagtgagacagagttgcacgtgaatgatgtagacactgatgttgcccatatctctttcactctcactcaggcacccaaacatggccacatgagagtgtctggacagatcctgcatgtagggggtctcttccacttggaggacataaaacagggccgagtttcctatgcccataatggggacaagtccctgactgatagctgctccttggaagtcagtgacagacatcatgtggtgcccatcactctcagagtaaatgtccggccagtggatgatgaagtgcccatactgagccatcctactggcactctggagtcctatctagatgtcttagaaaatggggctactgaaatcactgccaatgttattaaggggaccaatgaggaaactgatgacttgatgttgactttcctcttggaagatccacctttgtatggggaaatcttggtcaatggcattccagcagagcagtttactcaaagggacatcttggagggctctgttgtatatacccacaccagtggtgagataggcctattgcctaaagcggattcttttaacctgagtctgtcagatatgtctcaagaatggagaattggtggcaatactatccaaggagttactatatgggtgaccatcctgcctgttgatagccaggccccagaaatctttgtaggtgaacagttgatagtaatggaaggtgataaaagtgttataacatcagtgcatataagtgctgaagatgtcgactccctgaatgatgacatcttgtgcactatagttattcagcctacttcaggttatgttgaaaacatttctccagcaccaggctctgagaaatcaagagcagggattgccataagtgctttcaacttgaaagatctcaggcagggccacataaactatgtccagagtgtccataaaggggtggaacctgtggaggaccgatttgtatttcgttgttctgatggcattaacttttcagagagacagttcttccccattgtaatcattcccaccaatgatgaacagccagagatgtttatgagagaatttatggtgatggaaggcatgagtctggtaattgatacacccattctcaatgctgctgatgctgatgttcccctggatgatttaactttcactattacccaattccccactcatggtcacatcatgaatcagctgataaatggcacggttttggtcgaaagcttcaccttggatcagatcatagagagttccagcattatttatgagcatgatgactccgagacccaggaagacagttttgtgattaaactaacagatgggaagcactctgtggaaaagacggtcctcattatagttatccctgttgatgatgagacgcccagaatgactatcaataatggactagaaatagaaattggggataccaagattatcaacaacaaaatattaatggcaacagatttagattcagaagacaaatctttggtttatattattcgttatgggccaggacatggcttattacagagacgaaaacctactggtgcctttgaaaatatcacactgggcatgaattttacccaggatgaagtagacagaaacttaattcagtatgtccatttggggcaagagggcattcgggacctaattaaatttgatgtgactgatggaataaatcccctcatagatcgttacttttatgtgtccatcgggagcattgacattgtcttccctgatgtgataagtaagggagtgtccttgaaagaaggtggcaaagtcactcttacaacagacctactaagcactagtgacttgaacagtcctgatgaaaacttggtttttaccatcaccagggctcccatgcgaggtcacctggaatgcacggatcagcctggtgtgtccatcacgtctttcactcagctgcaactggctggaaacaaaatctactacatccacacagctgatgatgaagtgaaaatggacagttttgagtttcaagtcaccgatggacgtaaccctgtctttcggacattccgtatctccattagcgatgtggacaataaaaagccagtggtcaccatccacaagctggttgtcagtgaaagtgaaaacaagctgattactccttttgagctcactgtcgaagacagagatactcctgacaagctcctgaaattcactatcacccaggtgcctattcatggccatctcctattcaacaataccagacctgtcatggtttttaccaagcaagacttgaatgaaaacttaatcagctacaaacatgatggcactgagtcaagtgaagatagcttctccttcacagtgactgatggcacccatacagacttctatgtttttcctgatacggtgtttgaaacaaggagaccccaagtgatgaagatccaggtcttggctgttgacaacagtgtcccccaaatcgcagtgaataagggggcctctacacttcgcactctagccactggccacttggggttcatgatcacaagcaaaatattgaaagtggaggacagagacagcttacacatttctcttagatttatcgtgacagaggcccctcaacatggatatcttctcaacctggacaaaggcaaccacagcatcactcagttcacacaagctgacattgatgacatgaaaatatgctatgtcttaagagaaggggctaatgccacaagtgatatgttctattttgcagttgaagatggtggtggaaacaagttaacgtaccagaattttcgtctgaattgggcatggatctcctttgaaaaggaatattacctggtcaatgaggactccaaatttctagatgttgttcttaaacgtagaggttacttgggagaaacttcttttataagtattggcacaagagacagaactgcagaaaaagacaaagacttcaagggcaaagcacagaaacaagtgcagttcaacccaggccagaccagggccacatggcgagtgcggatcctgagtgatggggagcatgagcagtctgaaacctttcaggtggtactctcagagcccgtgctggctgccttggaattccccacagtcgccactgttgagatcgttgatccaggagatgagccaactgtgtttattccccagtccaaatactccgttgaagaagatgttggtgagctgttcattcccatcaggaggagcggagatgtgagccaggagttgatggtggtctgttatacccaacaaggaacagcaactggaactgtgccgacttccgtgttgtcttactctgattacatatccaggcctgaggaccacaccagtgttgtccgctttgacaaagatgaacgggagaaactgtgtcggatagtcataattgatgactctttgtacgaggaggaggaaaccttccatgtccttctgagcatgcccatggggggaagaatcggatcagagttcccaggggctcaagttacaatcgttcctgacaaagatgatgaacccatcttttacttcggtgatgtggaatactctgtggatgagagtgctggctatgtggaagtgcaggtgtggagaacgggcactgacctgtccaagtcttctagtgtcacagtgaggtctcggaaaacagatcctccctctgcagatgctggaacagactatgtgggcatcagccgtaatttagattttgcacctggagtcaacatgcagcctgttcgtgttgtcattctggatgaccttggacaaccagcgctggagggaattgagaaatttgaactggtgcttcgcatgcctatgaacgcagcccttggcgagcccagcaaagccacagtgtccataaatgactctgtctccgatttgcctaagatgcaattcaaagaacgaatatatactggcagcgaaagtgatgggcagatagttacaatgatccataggactggggatgtccagtacagatcttcagtgagatgctacacccggcaggggtctgcacaggtgatgatggactttgaagaacgcccaaacactgatacctccatcatcacattcctccctggtgagacagaaaagccctgcattcttgagctgatggacgatgtgctctatgaggaggtagaggagctccgcctggtactcggcactccacaaagcaactctccctttggggctgcagttggtgaacaaaatgaaactctcataaggatccgagatgatgctgataagactgttattaaatttggagaaaccaaatttagtgtcactgaacccaaagaacctggagagtcggtggttataagaattccagtgattcgccaaggagacacttcaaaggtttccattgtgagagtccacaccaaggatggctcggccacctctggagaagactaccaccctgtgtcagaagaaattgagtttaaggaaggggaaacccagcacgtggttgaaatcgaagttacctttgacggggtgagagagatgagagaggccttcactgttcacctaaaacctgatgaaaatatgatagcagagatgcagttgacgaaagccattgtgtacatagaagaaatgagcagcatggcagatgtcacttttccttctgtccctcaaattgtatccctgttgatgtatgacgacacttccaaagctaaggagagtgctgaacccatgtctggctatcctgtcatctgtatcacagcttgcaaccccaaatattcagactacgataaaacaggctctatctgtgcaagtgagaacatcaatgacactttgacgcggtaccggtggctgattagtgcacctgcgggccctgacggtgtgaccagccctatgagagaagtggacttcgacaccttttttacgtcatccaagatggtcacactggactccatatactttcagcctggctcccgggtacagtgcgcagctcgtgctgtgaacaccaatggggatgaaggcctggagctcatgagccctattgtaaccatcagcagagaagaaggtctttgtcagccccgtgtacctggggttgttggagcagagccgttctcagctaaattgcgctacacaggccctgaggatgcagactacacaaaccttatcaagctcactgtcacaatgccacacatagatggcatgctccccgtgatctccactagagagctttccaactttgagctcaccctcagccctgatggcacaagagttggaaaccacaagtgctccaacctcctggattatactgaagtgaagactcattatggtttcttgactgatgctaccaaaaatccagaaataattggagagacatatccttaccagtacagcttgtccatcagaggttccactaccttgcgcttctaccggaacctgaacctagaggcctgtttatgggagttcgttagctactatgacatgtcagaactccttgctgactgtggtggcaccattggaacagatggacaggtcctaaacctagtgcagtcctatgtgacccttcgagtccctctgtatgtttcctacgtgttccattcccccgtgggggtaggaggctggcagcattttgacttgaagtcagagcttcgtctaacttttgtgtacgacaccgccatcttgtggaatgatggaattggcagccccccagaggctgaacttcaaggttctctctatccaaccagcatgcgcatcggtgatgaggggcgcttggccgtgcacttcaagacagaggctcagttccatggcttatttgtgctgtcacatcccgcatcctttacaagctcagtgatcatgtcagctgatcatccaggcctgacattttccctccgcctcataaggagtgaaccaacctataaccagccagtacagcagtggagctttgtctctgactttgccgtacgtgactactcagggacctatactgtgaagctggtgccatgcactgccccatcacatcaggaataccgcctgccagtcacctgcaaccccagagaacctgtcacctttgaccttgacatccgattccaacaggtcagtgatccagtggctgctgagtttagcttgaacacccaaatgtacctgctctctaagaagagtctctggttgtctgatggatccatgggattcgggcaagagagtgatgttgcttttgcagaaggtgatataatttatggtcgtgtcatggtggatcctgtccagaatctgggtgactccttttactgcagcattgagaaggtgtttctatgcactggagctgatggctatgttcccaagtatagtccaatgaatgcagaatatggctgcttagccgactctccttcactcttatatagatttaaaattgtggacaaagctcagccagagacacaagcgaccagttttggaaatgtcctatttaatgccaaactagcagtggatgaccctgaagccattctcttagtgaatcagcctggatctgatggatttaaagtcgactcaacaccactctttcaggtcgctctaggccgagaatggtatatacatacgatctatacagtgagatcgaaagacaatgccaatcgaggtattggcaaaagaagtgtggagtaccattctctggtgagtcaaggaaagccccaatccaccaccaagagccggaagaagagagagatcaggagcacaccctcactggcatgggagattggtgctgaaaacagtcgaggaacaaacatccagcacattgccctggaccgcaccaagaggcagatcccccatgggagagcacctccagatggcatcctcccctgggagctcaacagccccagctctgcagtcagcctggtcactgtggtgggaggcaccacggtagggttactcaccatctgcctcactgtcattgcagtgctgatgtgcaggggcaaggaaagtttcagggggaaggatgccccgaaaggctccagcagcagtgagcccatggtgcccccacagagccatcacaatgacagctcagaagtttgatgactgcaggtagaattcaaccttttccgtaagtgcctcggaaaagatcacaatggaaccttaaatacttctggtaaaccatagagaatggaggatggctgtgatgaagctgcttagagaatatgactgtactaatggagtttgatttgaattctccatactcttttttgcatcaaaggacaaattaaggcatctttcctcttgccccaaaggcagcaacaacgtactcatatgtacacagagccatgatgtgaggaatgtactcctcattttagacatattctctatgcagtggagataaatctattaaaaggtgctaacagactctcttacaagtgtaagaggaatctactgttgctatgttagtgtgaatgttgaaggtgcaattatcacattgtttattaattgtataacagattattactagaaaggtttttgttgctagtctggaaaactggtgaacacactgtttattatgacaagttttcaaataggtgaagacagcatagaattatgaccagggtggctcaacccacaaatcaactgatctactacttgggagacagtggaaggaaagatagagggaaggaagttcactcacttgaatttgaattgcttctcattctcatcagactctccttgttttgtttgcatatttaattttaaattaaaccaaagaatatgttaattctgaaagagatttttaagagatgctgctctgttttggcatatagtgagtaatggtagagctcttgcatggtaatataccttattggtgctcaacatttgtgggaaattagagggttggtgagattttggtgatgaataaatgccatagagttagagtcactacaagacaatgttctctaagaactgagcctagatgtttgcagtattgaacccataaatgataataagaaacattgttacagatggtgaagggagaaagtggtatttattaatataatgtgtataatcagagtgcctcttatacatactttatagaataaaggaacattttgacagatgaggttatccctcggagtagcgtaatcacacaataacatttagaacttaaattggctacaggacattttattagctttctatccagcatctggtccaaacgatgggactctctgcaactatcattccagaaatggtcttggaggtggccagaatcattgaccatatttttatttggttcaagaagacatcgctctggcatccccagttcagtgaactggtacaatgtggtccctctcaatatttaaaaatataatttgtaacagtgcttaccattcacctcccaaagccaaggaacttgagtgagcttccttggcaagcctcccattgcctttctgcatcaatgtgtttgttaccaaatagcagaaatttcgcttagaaggggaaaacttcagctttccaaaagctagtaaacatgtttcaaagaaaaataaggtcaggagaaaaagaataatgcctacagattatccttcagatgctggctagaatcccctttgacttctagccataagctggccacattggacatcttggtcactgcagaattttaaaaggcaaacttctcagaacagatgtgcacatcttaatttggtgtctgtaagtatcaaccatttcttgatcaagataaggaagcaacactgatactgagagagaggtcatatgtccaatagttgcctttcttctcttaggcagctctgcacttcatgttcagttttttaaaaatagactgtagtatcctttcattggagaatttacaaaaatatcatctacagctcaaaagtcccactaacggcttatatgaacagaaagtactgtgtagcccaggagtttatttagcaagataaatagtggtaatttcttaatcattcccctttcctttgctttaccttctggcagatgcttagctacttctttggctacctcataatttgtatgggaatgaacatgaattagggaacttcaaatagtgcgtagacttttccctacttaccattgggttcaattgatgtagactgttagagcaagtatactcaatcaacttgctgatattttagtagttaacagcttccgagcctatcatgcaatttggagtctgtcaatgaatatagcaatcggtgaagcattactgtacgaagtctgttttcaggctttgggtcaagctggttttataccaaatttcactctacaatgcatattctaatgaagctactttatataaattggagagcttataaaatgcagaacatttctatcctatcctaccaaatatttatccttctctgtcctctattctcttactctcctctctccctttttccttccctttattcccttgaaaaaagagaatctgtgggaaataggcagatatagctttttaaaatataaagtacttgggattttgcattatttttcttaatatctatttactaagtatgtaatttaatatacattaattattttttgaaactcttgttagtgggaagaatatggtaaattttttgttaaataaaatagacccttatgtttagcattttgtttttagagaactattctggtactatcagaacaaatacataaaataacttcccatagagaacaggatatagcaataatagctccttagatactcagtggcttctgactccaatcaaggtcttgttgatattatatagtaaaaataaaaccaaaaataaatattattcaagtggctcttctaagcatgtgaatcatgaagcactgaaatatgtattttaatgatgatcttatttattcccatttttgcccttagttaacatttactggtgctcacctaggattggctattctgagggattgcatagaaaccaagctccacttgctgtccttgggaaggttataactgaatgcagctctttatttggactaaagtgtcaggatatgcattagattctctcctgaaccaaaaacacaacagtcattatctgtgaaccataatttaaaaatctttctagaataacaacagcagactccactcttgtttgtctaaaagagccctactgggtatggatcattctgatgacagatttatacaaaatgattcaaaccagtaacttagtaaaattgaccttcgcaaaacctcactgggggagtgccttgtagagctgtgggtgggactgcacattcttttcctcttagtaaaagataggcccactttattccaagaataacacttagcacataaactcttcttccagctcgttagcagcattagcaccttctgaattccaccctctcagaagaatccacagtgtttgaacaatttgcataaaggtcagctagcatcctgctgccaagccactgcatagcatttgtgataagaaggaccaactctaggctcaatatgaagggatttagttctgtaagcagcaaaaaagcttctttatcaagtcatcttacctctaattcttttccagtgtgccaactccaaagtcaacattaaaaatgtaaatggacctgtgtaaatatcacagagagcttttccttatacatctcaatgctgagagttaaaatattcccaggttaaaatttttttaaagtaccaataatagagctaaatacaatgacatttgcttttaaaaggtggatattttatttctgctttttgaaaatacttatttagtattgacttggaagccaatttggtcctttaataagtaaagaaaataatatgtttaaaaatgtaaatgttttacaaatttgaaactttcataattgtattaatcagaaaacaagcacattgccattctttgaaactcatgtttctagacatgacagcagtaataaaaggatgaaaacaagtgtcttcactaagcgtatggccaataaatgggacccaaacgttcaatctgttcagtttaccaaggttcagaaatacgtaatttagcaggaaactataaataccagtgctatcacagccacacatacacacacacagacataaaataaccaaacatctcatttctaggaaagagataacactaaaggcatcataggtttaactgaaatacgttatatgaagttttacaaaaaggtcaacagaaagctcatttgtgaaaacatactctcatgggagcttctttaacattagttcagaggttaatatatttcctggaggtgttttcctagaattgattgcactattgcatggtaataacatttaattgttaaggaaacattatatataggttcaaattatcccttaatgttgatttctccccttttccatggattttgatactaagaaacaaaatgctttgagattttggtaactattttgattttgataaaacatgttaaaatagaaggacatgatatttttctatagtttccatcaggaagagtacatcagaaacttctccataaggaaagaaaactgactctctcttgaactagtgttgacaaaatacactaatgtctttcttaattttattttattaggagaaaaatcagaatattaaatttgcaaacttttgaacagcagtaatagctccttagacactcagtatctttcttccctatctttcaagcacatttaatttctttcccctggtatttgtttgctttgtgttttttcaatattttgtttgctaaagaacaataacaacaacaaagctggtccagccctgacacctacttttgctttttttctttctttcttttaatttgttgaactataggtttctttctgagatgtatttttcattcttccaataatgctctctttttcatttcaaaaccattaccactttcaatatgtaattaacatcctcattcatcagaaagctggtaagtccacacagcatttgtgcagtatcccttctgtgtaaaatgttaaggctttcagatgaaagaaaaaagaacttcctgcaaaagatcaaaagcatcatactaaataaaatgatgacaatatgtgccttgatttttctctcaatggaggttcaacattgacatttaagatgtaaaaaaaattactttgatggtttaattaagaataataagtcaaatatcacatgtatgtagttcttttggatgaccgaataccttaaaatgaactaaataactgaaataaagtgttaaaatgttaacagcgttgaagtttttaaaattataattatcaaatgcacaatgttcttttactatgccaaatgttgcctacactgattacatgattgtcacagtttaagtgaatttctactatggatctttattttccccaatgtttggatcatcctctcagataagaattgtcagtattgcacctcaagaaagaagaaaaaataagaatgtaaatttttaaaagctagcattaaaagtaaagagcagtacaataaaaatcacttaaaatagagaaaggcaactactgagtaagaagaaaagataatttctgtaaaagctaaatttatgcacattacaaaaagtagtcaagtcagtcttccattgtgacttcaggaattcaaatgcaagttgttggcaaaatatatatatacacacacacacacatacacacacatatatgtacatacatatatatatagagagagagagatagattttttttttttgagacagagtttcgctcttgttgcccaggctggagtgcaatggaatgatcttggctcaccgcaacctccgcctccagggttcaagtgattctcctgcctcaacctcctgagtagctggaattacaggtgcccactaccatgcctggctagtttttgtatttttagtagagacagggtttctccatgttggtcaggctgatctcgaactcccaacctcagatgatcctcccgcctccacctcccaaagtactggaattacaatggcgtgagccaccacaagatatttttaaagcccatttgtctataaaagaaaactcttggacaaggagctttgtgttttataattgtattacgtgcctgcttccttaccaagtgccctccataacactaagtaaatttatatttatctagcctctgagtgacatatctgtgtgtaatggaattatttgcagaatttaatagccttttttattttcgcatgagaatttttcaaaaactatcagggtctagttttatcatacatttactaagttactacatattggtggatattgacgtttattcctgggaatctaattttgcaaacaatttggagccattcagtcataaattcatgtcaacaataagtcttgctgccgcttgtgtttcataactacgcttgctttccttcaaaatataccaagtgtgtaatataaataaagcccatatcaatataaa

SEQ ID NO: 135324 - DNA, 3330 bp, Homo sapiens
  Payload ID: 6445
  Gene Symbol: FRAS1
  Gene Name: Fraser extracellular matrix complex subunit 1
  ENST ID: ENST00000264899
  CDS Start-End: 31-984
ggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccttggcctcccaaagtgttgggattacaggcatgagccaccatgcccagtcactacttgggccatttttgactcaaataaagaagccacatttctcctgtttagagtgataaatttaagaaaaaagtaaaaattggaaggaattttagccgttccttctggaaaccctgaactgtatagcctaatgattattgggtcactggccgcttagacctctctcagcttctgttgcctagaggaataaaatctgaggggtaaaatttaaaaaaattcatgttattgaagaaaaaaaaatggtgttgagctcttctttcaaatgaattctaataaatatgacactgtctataattcaggaagttaatagccttttaattttggatctgatttttgcaaagggtcatggagaagggaaggggaaagcctgttgccttcagatctgctagctgcacttttctgtgttgatgtatatccaggcaatgtttgaagacacaagggttttcttggtctcctctctctagaataacattgtgatgacaatttcaaatcaatcagttagactcaaattaaaatcaagtaaaaaacaagacatctatcatttagatattgcttactcttcccctgggccttttgcagtgtttggggttgggatgagaggagtaatctgagccagcattttctgtggagctctgaatggtaactgggcatctcggtacctgaatggtggtacccaagcgcctcagtgcctgaatcccacctgagcatcatagtatctgaatggtacctgagctctgaatggtcctggagcatcacaatagccctggtgctctatcccaggggctgggctctgacccatgcagaggttcccttaagaaactgggaggtccaatgaaaacatgctgcaaatgtttcttcgattaaaagatacacagttaacactacagatgtttttagattaaaagatatgcatttaacattttcttatgtagtgaaagagggttcctcatgcaggatatgccagatagaatggttttgaaactagctggagcttaaggtagaatctctgcttctgtattgtcacttgccctagtaacagaagttatgatcagagactcctaataaaacaaccagtggttctatgttatataaattattgtaagtttttttgcatattatctcatttgattccttttggaaatggcagggcaggtatatccatttatagatgagaaatagtcagtgaggaaacggatctgacccaggccttccaattcctggtcttgtgcttatcccactctcccaactttatcctcaaatacattttctttttttttgccgaaaatgataccttgttttctagttcagcctagtaagcaggaattgatagatcaaggtaaaaatgctctcttgatgttgatgcaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggac

SEQ ID NO: 135325 - DNA, 7142 bp, Homo sapiens
  Payload ID: 6445
  Gene Symbol: FRAS1
  Gene Name: Fraser extracellular matrix complex subunit 1
  Uniprot ID: Q86XX4
  ENST ID: ENST00000325942
  CDS Start-End: 441-6371
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggac

SEQ ID NO: 135326 - DNA, 2125 bp, Homo sapiens
  Payload ID: 6445
  Gene Symbol: FRAS1
  Gene Name: Fraser extracellular matrix complex subunit 1
  ENST ID: ENST00000510944
  CDS Start-End: 1-1279
cactctacctctgcatccaaatcaaggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgaggtaaagactttggaagttggaaaggttgagcccttgaccacaatatttcacaccattagagagctttctttatagggactcaaaagcaaagaagattggatttgaccttcaaaattgaaggtcgttcttaaaatatagccttcaggaatcttgtagaattaaggttggcatttggggaaggcttgagttagaaatctaaatttccatttcaggattgaatttatttgttcggtgtgaaaaacagtttgtgaaggtcagagatgctttgccagtctcatatataaatgaaaacttacatatgtctatgtttctctgaaattgtgtttggttctatatgcatatttgccttttcttattttactgcatttatttatttaattgtaacatcaaagaaatgtgttccttgatgctgtatttattctcatttgagcaactacacaggcttgctctaccgagagagagacacaggggaggggaaagataaatctcagaatgaaataccctctgccttgggaaaataaaatgtaaagaaccctctgcactcttaagggtcagtggtggaaaggggctggcaccagggcagggagacagctttagagacccacactttcaaatatagtgtccttctacaggtactgtggtatgcttagcattttctaagagagttctgagttatattagtatggtcttttatcttcaaagtatgttaatacttgtacttgtcaaagcacatatccatatttttggtctagaaaatatggtcattgtacttacggaagatatctgagaaaacttttatgaaatgtccatcagcttcttttgaagggggcattttgttgcctggacttgctctcttttcaaactaactattttgcttgggaagtaaagatggtgccacattaaatgctattttgaggtgaa

SEQ ID NO: 135327 - DNA, 15624 bp, Homo sapiens
  Payload ID: 6445
  Gene Symbol: FRAS1
  Gene Name: Fraser extracellular matrix complex subunit 1
  Uniprot ID: Q86XX4
  ENST ID: ENST00000512123
  CDS Start-End: 441-12479
aactttaaaaagctgcttcggacaaaccagagccaggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggatgccacaatttggaagcccgattcatgccagagctgccgttgccatggtgatattgttatctgcaaacctgctgtttgcagaaaccctcaatgtgcctttgagaagggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccagaatgcccactacctgctgctcggggaccactgtgttcctgactgcccttcaggatactatgcagagagaggagcttgtaaaaaatgccactcctcctgcagaacctgccagggcagaggacctttctcctgctcctcatgtgacaccaacctcgtgctgtcccacactggcacctgcagcaccacctgcttccctgggcactatcttgatgacaatcatgtttgccagccatgcaacacacactgtggaagctgtgattcacaggccagctgtacctcctgccgagatccaaacaaggttctgctctttggggaatgtcaatacgagagctgcgccccacagtactatcttgacttctccaccaacacgtgcaaagagtgtgattggagctgcagtgcatgcagtgggcccctgaaaacagactgcctgcagtgcatggatggctatgttctccaggatggggcctgcgtggagcagtgcttgtcatcattttaccaggactcgggcctctgcaagaactgtgacagctactgtctccagtgccaaggtccccatgagtgtacccgctgcaaagggccatttctcctcttggaagcccagtgtgtccaggaatgtgggaaggggtactttgcagatcatgcaaagcacaaatgcacagcctgccctcaggggtgcttgcagtgcagccacagggaccgttgtcacctctgtgaccatgggttctttctgaagagtggcctctgtgtttacaactgtgttcctggcttttctgtccacacctctaatgaaacatgttctggcaaaatacacacccctagtcttcatgtgaatggttccctgatcctcccaattggttcaataaagccactggatttttccctcctgaatgtccaagaccaggagggtagggtcgaagatctcctatttcatgttgtgagcactcccaccaatggtcagctagtgctctcaagaaatggaaaagaggttcagctggacaaggctggccgttttagctggaaagatgtgaacgagaagaaagtgcgttttgtgcacagcaaagaaaaactcaggaaaggttaccttttcctgaaaattagtgaccagcagttcttctctgagccacagctgatcaacatacaagcattttcaacacaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctttgagcttcggagacctccacagcatggtgtgcttcttaagcatacagctgagttccgaaggccgatggccacaggtgacactttcacctatgaggatgttgagaaaaatgctctacagtatatacatgatggttcctctacccgggaagacagcatggagatctcagtcacagatggcctcacagtgacaatgctggaggtgagagtagaggtgtccctgtcagaagaccgagggcctcgactggctgctggctcctctctgagcattactgttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataacaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgagaggaagaacgatgagcctcccaggatgaccttgcagcccctcagagtgcagctgagctcgggagtggtgataagcaattcttctttgagcctgcaagacctggacaccccagataatgagctcatttttgtattgacaaaaaagcctgaccacggtcatgtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggccacgtagaatatagtcatggaacaggagaacctggagggagctttgcttttaaatttgatgtggttgatggagaaggcaacagattgattgacaagtcattttccatcagcattctagaagacaaatccccaccagtcatcaccaccaataaaggactggtcttggatgaaaactcagtgaagaaaatcaccaccctgcagctgtctgccactgaccaggacagtgggcctacagaattgatctacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagaggccgagtctgtcacattcaccatcgtgcagcctccacgccatggcaccatcgagcgaaccagcaatgggcagcatttccacctcacctccaccttcaccatgaaagatatctaccagaaccgggtcagctacagccatgacggcagtaactccctcaaggaccggttcaccttcactgtttctgatgggacaaaccccttctttatcattgaggaagggggaaaagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttaaatctagagggatgtctgccgcgagtcgtgtgatattcgggcctggtgtgaccatgtccacctgtgatgtcatgcttattgatgacagcgagtatgaagaggaagaagagtttgagattgccttggcagatgcctctgacaatgcccgcattggaagggtggcgacagccaaggtgctcattagtggtcccaacgatgcctcgactgtgtccctgggcaacacggctttcactgtcagtgaggacgcaggcacagtaaagattccagttatccgccatggtactgacctctctactttcgcatctgtctggtgtgcaacgcggccctcagacccagcttctgccacaccaggagttgactacgttcccagctctcggaaggtggaatttgggcctggtgtcattgaacagtattgcaccttgactatcttggatgacactcagtatccggtaattgaaggactggagacatttgtggttttcctcagctcagcacaaggagccgaactgaccaaacccttccaggcagtcattgcaattaatgacacattccaagatgtgcccagcatgcagtttgccaaggatttgctcctagtgaaggagaaggagggtgtcctgcatgtccctatcactcggagcggagacctgagctatgagtcatcagtgaggtgctatactcagagccattccgctcaggtcatggaggactttgaggagagacaaaatgcagactcttcacggattacatttctcaaaggggacaaagtgaagaactgtacggtctatatccacgatgactccatgtttgagccagaggaacagttcagggtctacctcggccttcctcttggaaaccactggagtggagctagaattggaaagaataacatggccaccatcaccatatccaatgatgaagatgcccccaccattgagtttgaagaagctgcataccaagtccgggaacccgcaggcccagatgccattgcgattctgaacatcaaggtgatccgcagaggggatcagaacaggacctccaaggttcgctgcagcacgcgggatggctctgcccagtctggtgtggattattacccaaagagccgagtcttgaagttcagtcccggtgtggatcatatcttttttaaagttgagatcctgtccaatgaagaccgggaatggcatgaatctttctcactagtccttggcccagatgacccagtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccaaccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtatgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttgtgtgtgttttactaaccttttatatcttgccttcaagtgagaaggaacaaacaactctcagtggttactacttgcttttatatgctggctgtgaaggttaaaagaaagaatggtctgtaccattctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttt

SEQ ID NO: 135328 - DNA, 2217 bp, Homo sapiens
  Payload ID: 6445
  Gene Symbol: FRAS1
  Gene Name: Fraser extracellular matrix complex subunit 1
  ENST ID: ENST00000502446
  CDS Start-End: 1-2000
agggagaagtgcttcaaatagctgccaaccaatgctgtcctgagtgtgttttgaggactccaggatcttgccatcatgaaaagaaaatccatgagcatgggacagaatgggcctcttctccatgtagtgtgtgctcttgcaatcatggggaagtccgatgtaccccccaaccatgcccaccgctgtcatgtggacaccaggagctggcattcatccctgaaggaagctgctgcccagtttgtgtgggccttgggaaaccctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagggcaaaatctggacttctgtcagaatttagaagtgatttctgctgtttgccttggcatatcatctacagagaattgatgacatcctgaataaataatttgactcaatagccaggccatctatgagtggttgaggagatgaaagggaagtattatagtttcctttctgttcccacaagtagccttgctgttgggtgaatagtttgactctaaagctacgtgaaaaaaaaatcattagtttgtatttttcattgtaaacatatgttcattaaaaaaattttataatacacccacta

SEQ ID NO: 135329 - DNA, 2169 bp, Homo sapiens
  Payload ID: 6445
  Gene Symbol: FRAS1
  Gene Name: Fraser extracellular matrix complex subunit 1
  ENST ID: ENST00000508900
  CDS Start-End: 1-1957
ctgttcctatgaaggccatgtgtttcaggatggggaggactggcggctgagccggtgtgccaaatgtctgtgtagaaatggggttgcccagtgcttcacagctcagtgtcagcctctattttgtaaccaggatgagactgtagtccgagtccctggaaaatgttgcccgcagtgctctgcaagatcctgctctgcagctggccaagtatacgagcatggtgagcagtggagcgaaaatgcctgcaccacgtgtatatgtgaccggggtgaggtcaggtgtcacaagcaggcctgcctgcccctgagatgcggaaagggtcagagcagggctcggcgtcatgggcaatgctgtgaggaatgtgtgtctcctgccgggagctgctcctatgatggagttgtgcggtaccaggacgaaatgtggaagggctcggcctgtgagttctgcatgtgtgatcatggccaagtgacctgccagactggagagtgtgccaaagtggagtgtgcccgggatgaagaattaattcacttagatggaaagtgttgtcctgaatgcatttcaaggaatggttattgtgtttatgaagaaactggagaatttatgtcatcaaatgctagtgaagttaaacgtattccagagggagagaagtgggaagatggcccttgcaaggtgtgtgagtgccgaggggctcaggtaacttgctacgagccctcttgcccaccatgtccagtgggcacactggccttagaggtgaagggacagtgctgtccagactgcacatcagttcattgccatccagattgtttgacatgctctcagtctccagaccactgtgacctctgccaagatcctaccaagttactgcagaatggatggtgtgtgcacagctgtggactgggtttttaccaagctggcagtctctgtttagcctgccagccccagtgctccacgtgtaccagtgggctggagtgctcatcctgccagcctcccctgctgatgcggcacgggcagtgtgtgcctacctgtggggacggcttctaccaagatcgccattcctgtgcagtctgccatgagtcctgtgcaggttgctggggcccaacggagaagcactgcttggcctgcagagatcccctccacgtgctgagagatggcggctgtgagagcagctgtggaaaaggcttctacaacaggcagggcacctgtagcgcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccatggagtctgcaaagcctgtcactcctcctgcctggcttgtatgggtcccgcaccctctcactgtactgggtgtaagaagccagaggaaggactgcaagtggagcagctgtctgacgtgggcatcccctctggcgagtgtctagcccagtgtagagcccatttttacttggagagcactggcatatgtgaagcttgccaccagtcctgtttcagatgtgcagggaaaagcccacataactgcacagactgtgggccttcccatgtgctgttggatgggcagtgcctctcccagtgcccagatggctactttcaccaggaaggtagttgcacagagtgtcacccaacctgcaggcagtgtcatgggccgttggagtctgactgcatctcctgttaccctcacatctctcttaccaatggtaactgcaggaccagctgcagggaagagcagttcctcaacctcgtgggatactgtgctggtgagtgaaactcctgtggactcctcggaaatcactgggcagctgccggggctcttcataccaggcttaagggggctctttgtcctcagtttatgagctcttttataggagacatttgtttcatgtctggaaactcatgttactgcttctccttgggcatttagtaaatacttgtggatttaaatagaacttctaataatactcttgcaaatcctgaaaa

SEQ ID NO: 135330 - DNA, 2297 bp, Homo sapiens
  Payload ID: 6445
  Gene Symbol: FRAS1
  Gene Name: Fraser extracellular matrix complex subunit 1
  ENST ID: ENST00000508909
  CDS Start-End: 407-526
aggatttccactgtcggggacccgggatcggaagggtctagcccgagggaaatgctggaagatcccatcggccagtgaccagcaactttccggcgagattttgacgcggagaactgtgctctgcctcctcttattctcccaaagctcacgttggcgtcctgccttgcgggggaactcggcgcgctctctgcctgagcagcgagtgaattgaaccccagcccgctccggcgcctccgggctgatgagtgtcgctctccgcccgtccatctctttttcccggaggtaaaggcccgcggtcccccaccttcagtgcgcccgggttccaagcgccggagccagcgttttggcggagccgcttcttggatgctgaaggctgggctcctccatcgtgggtgccgaggcggcgatgggtgtcctcaaagtgtggctcgggctggccctagcgttggcggaatttgcagtattgcctcatcattccgaaggtgcttgtgtctatcaggattccttgttggcggaaggtggatgagccattggaggtgccagagaggaggaatggcaacactggacttatcatctaattaaactgctgaaatgagagtgtgcttgtttccagggaaactatattaaatactttaaaaagactccatagggagtaagaaatgaccagaagggactaaaaataacttgaaaaacactgaataatctattttggggtgtgtttcttactccataatacccatgcacccctgggctcacaagactttctctaaagtcagcccttgtggaacacagcgtgactgttaaatcaggaatccatcagagggaaactacctaggtaataggtttaactgtgatgtccagtgtgaggaggaaaattaatttttcatttcaaagttttcacacaccttctgttcttttccaactatatcaagtattgaaaaaactctccttttgcatcaccacaagcaaacacatatccttttgaaagttcttcctgggatcaatgacttgactcttcacttcaatttttctgtctgtgaaatggagatgaactatttacttctcaggactgttgtgaagcttaaaggagatgaacatgaagcaactcgtccagtgctgtgacttacagtgctcaataaaggttggctgctattattgttgttctatagcagtgacgactggcaaggttggataaatgactcttcttccctggatcaaaagtgttaagtgttgggattttcctacttgggatacttttgctgagaaatgctgacaaagtgaatcacaaggcactaactcttagcaaatttgaaagaatatttttcaaggataatttaaaaatgtggaatgttgactatatataacactgcaggaaaatccaggctttggagtttgaatcttggcaccactacatacatgctgtgtggtctcagatataatactttatacagccaggtgtcactttcattatctacttaattgggattatatttctcctaggtttgatgtgacagttaactgagaacatacttgtgaaagaacccagaactgtccctgcaaggaacacgtactcacatcattcaggtggtaacaagatgtcggagtagaaatgagtgagttatagagtccagggtcttggttcaggttctggccctgtaattactagctgtatagcttggagtaagtcacttgaatgaaatgaggtctcagtttctaaattagtaaattaagagagttaggttagcttttctccaagattccttagcccagtatcgtgtagtagagctttctgtgatgatgggaatgttccatagctgtgctgtccagtgtggtagctacgagccacatgtggttattgagtacttgaagtgtggctgacgatactgaggaactgaattttaaatttcacttaatgtcaatgaattaaagtttaaatttgagtagccacatatagatagtggctactatattggacagtgcaacattagagttttaaaattcttaacgtactctagtacttaaaatacagcctcatgaatggttctcaccctgggtggaagcttactggagtacttttagcagttgtgagaaaagtaatacaaagtttgttatagtacctaagtttgctgtttttgtttgtttatataatttgaacagttttgaagtcaacacagttacaacactactctctccatattgctaaatatgttttcttttttgttgtcgtggttttttttttaaaccaagcaattgttatggatcaatgctttcttgaataaaagaaaaggagtaaaatt

SEQ ID NO: 135331 - DNA, 2608 bp, Homo sapiens
  Payload ID: 6446
  Gene Symbol: FXN
  Gene Name: frataxin
  Uniprot ID: Q16595
  ENST ID: ENST00000377270
  CDS Start-End: 525-1157
tttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataa

SEQ ID NO: 135332 - DNA, 980 bp, Homo sapiens
  Payload ID: 6446
  Gene Symbol: FXN
  Gene Name: frataxin
  Uniprot ID: Q16595
  ENST ID: ENST00000396364
  CDS Start-End: 221-736
agtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctggg

SEQ ID NO: 135333 - DNA, 922 bp, Homo sapiens
  Payload ID: 6446
  Gene Symbol: FXN
  Gene Name: frataxin
  Uniprot ID: Q16595
  ENST ID: ENST00000396366
  CDS Start-End: 22-612
gggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggtatgtagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttat

SEQ ID NO: 135334 - DNA, 856 bp, Homo sapiens
  Payload ID: 6446
  Gene Symbol: FXN
  Gene Name: frataxin
  ENST ID: ENST00000498653
  CDS Start-End: 106-513
aaggaaaaggggacattttgtcctgcggtgcgactgcgggtcaagagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaa

SEQ ID NO: 135335 - DNA, 359 bp, Homo sapiens
  Payload ID: 6446
  Gene Symbol: FXN
  Gene Name: frataxin
  ENST ID: ENST00000484259
  CDS Start-End: 1-325
accagatttggaatgtcaaaaagcagagtgtctatttgatgaatttgaggaaatctggaactttgggccacccaggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctat

SEQ ID NO: 135336 - DNA, 2311 bp, Homo sapiens
  Payload ID: 6447
  Gene Symbol: FFAR1
  Gene Name: free fatty acid receptor 1
  Uniprot ID: O14842
  ENST ID: ENST00000246553
  CDS Start-End: 1-903
atggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccggtctgcctggaggcctgggacccggcctctgccggcccggcccgcttcagcctctctctcctgctcttttttctgcccttggccatcacagccttctgctacgtgggctgcctccgggcactggcccgctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcgggggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacccacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaaccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgcgtgcctgtagtcccagctactcaggggtctgaggtgggaggatcccttgagcccaggattgaggctgcaatgccatgatcgcaccactgcactccagcctgggtgacagagcaagatcctgtctctggaaaaaaaagaaaaaagacatattttgtatgttatatatattatgtgctgtattcttacaataaagtaagctagagaaaagtacatgttactgaaaacattattagaaagagaaaataccttcacagcactgtgctgtatttatcaatactgtaagttttgttgtctgtttataagagaagttgtctgtctcaagcggcagtaaccgcggctgcagatctcaatctgtggtagatatcaagcagttcaacccttttttataatgtcatgacttttctttgcttcttggaagcagctctggcatcactagtggccccgcatttggggccaagggggttattcaaagtttacggtattgcattaaacatggtgaaaca

SEQ ID NO: 135337 - DNA, 2051 bp, Homo sapiens
  Payload ID: 6448
  Gene Symbol: FFAR2
  Gene Name: free fatty acid receptor 2
  Uniprot ID: O15552
  ENST ID: ENST00000246549
  CDS Start-End: 1-993
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggagcaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcctataatcccagaactttgggaggctgaggcaggtggatcacttgaggtcgggagattgagaacatcctggtcaacatgggaaaaccccgtctctactaaaaatacaaaaaaattagctgggcatggtggcacatgcctataatcccagctactctggaggctgaggcaggagaatccttgaacccgggagttggaggttgcagtgagctgagatcacgccactgcactccagcctagcgacagagcaagactccatttaaaaaaaaaaaaaaaaaaaaaaagaagcaccttcaggctggagaagcagcgtagctaacacaagtccagtccttgtgatgtggctggtagttggggatggccaggctgaagcagagagtcctagagaaatctcgatacaagcttcaaagcaacacctagacactgctctagcggttgatcctggagataaaccaacaagagagagatggaagagaaatactaaatgaggtcaaagaagactcagaaaggttctgagcctggagatgagcagggaggcctcagggcttagacctttaatgataggggtttccctgcattggtttgacctgttgcctttttgatgtgctctgtttgttttcatgtgttgtcttgtctcccctgctaaactgggagctgccaggggtctgggtcttatctccttcctccatggtaccccacacaggccaggatgtggtttggtacccagcaatcagagattggcactccctcatacaggggaaagcaacctggtctagcaaattgaaaataaagatgataaaactctg

SEQ ID NO: 135338 - DNA, 2133 bp, Homo sapiens
  Payload ID: 6448
  Gene Symbol: FFAR2
  Gene Name: free fatty acid receptor 2
  Uniprot ID: O15552
  ENST ID: ENST00000599180
  CDS Start-End: 81-1073
tctgttcctctctcctggaagcttgcagacctcccttcagaaccaatcccaagaagccacctatccggaacaacacaaggatgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggagcaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcctataatcccagaactttgggaggctgaggcaggtggatcacttgaggtcgggagattgagaacatcctggtcaacatgggaaaaccccgtctctactaaaaatacaaaaaaattagctgggcatggtggcacatgcctataatcccagctactctggaggctgaggcaggagaatccttgaacccgggagttggaggttgcagtgagctgagatcacgccactgcactccagcctagcgacagagcaagactccatttaaaaaaaaaaaaaaaaaaaaaaagaagcaccttcaggctggagaagcagcgtagctaacacaagtccagtccttgtgatgtggctggtagttggggatggccaggctgaagcagagagtcctagagaaatctcgatacaagcttcaaagcaacacctagacactgctctagcggttgatcctggagataaaccaacaagagagagatggaagagaaatactaaatgaggtcaaagaagactcagaaaggttctgagcctggagatgagcagggaggcctcagggcttagacctttaatgataggggtttccctgcattggtttgacctgttgcctttttgatgtgctctgtttgttttcatgtgttgtcttgtctcccctgctaaactgggagctgccaggggtctgggtcttatctccttcctccatggtaccccacacaggccaggatgtggtttggtacccagcaatcagagattggcactccctcatacaggggaaagcaacctggtctagcaaattgaaaataaagatgataaaactctgaa

SEQ ID NO: 135339 - DNA, 1796 bp, Homo sapiens
  Payload ID: 6449
  Gene Symbol: FFAR3
  Gene Name: free fatty acid receptor 3
  Uniprot ID: O14843
  ENST ID: ENST00000327809
  CDS Start-End: 202-1242
ccccttttagcatgctgaccagccctggcaacggagctcaaggcatctatgtgccactgctcaacagtgagtgacgtcatgggcacggccaggtctttatcagttctgccggataaatagccaactgcactaggtctggagagacagcaaggtgctgtgcggcagagcatttggggtctcaaagaagcagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaagctaggtcctccgggggaggagggtgtagctggcatgtcatcctcagggcgcttcctcgctcacgccaggagggacttggagtggcgagctggggcccgatggggcttgggggcagagtagacatctagcctccctaagggtatgcgcgctaaagcccagctctcgatctcacctccatccccatccacccacacactatggattgggctctgggaaggggtcagggtgagaggctgctctggagaacaatgaggtcctcatagcagcaggcagctcctgtgttttcttgagggtggcagaggagctaagagcagtgcccagggtctgagggggctgcccagtgagtggcaggggcaggagaggggagaaccccatcctcagagctgctcccagccagcgagtcaggagcgggggagacagggctccagggatgaggccgcattctgctcccacagcgccttttccagaaagttcccattgctcaataaatgtggatcatcagagacatttatgaacaatgacagaagaaaaattacccaaataaatgtggaagcaagc

SEQ ID NO: 135340 - DNA, 1182 bp, Homo sapiens
  Payload ID: 6449
  Gene Symbol: FFAR3
  Gene Name: free fatty acid receptor 3
  Uniprot ID: O14843
  ENST ID: ENST00000594310
  CDS Start-End: 71-1111
tgctggccagaggccgttagggcccccactaccaactccatgttactctctctcaccagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgcttcctgagtgtggcccacccactgtggtacaagacccggccgaggctggggcaggcaggtctggtgagtgtggcctgctggctgttggcctctgctcactgcagcgtggtctacgtcatagaattctcaggggacatctcccacagccagggcaccaatgggacctgctacctggagttccggaaggaccagctagccatcctcctgcccgtgcggctggagatggctgtggtcctctttgtggtcccgctgatcatcaccagctactgctacagccgcctggtgtggatcctcggcagagggggcagccaccgccggcagaggagggtggcggggctgttggcggccacgctgctcaacttccttgtctgctttgggccctacaacgtgtcccatgtcgtgggctatatctgcggtgaaagcccggcgtggaggatctacgtgacgcttctcagcaccctgaactcctgtgtcgacccctttgtctactacttctcctcctccgggttccaagccgactttcatgagctgctgaggaggttgtgtgggctctggggccagtggcagcaggagagcagcatggagctgaaggagcagaagggaggggaggagcagagagcggaccgaccagctgaaagaaagaccagtgaacactcacagggctgtggaactggtggccaggtggcctgtgctgaaagctaggtcctccgggggaggagggtgtagctggcatgtcatcctcagggcgcttcctcgctcacgccaggagggac

SEQ ID NO: 135341 - DNA, 3605 bp, Homo sapiens
  Payload ID: 6450
  Gene Symbol: FFAR4
  Gene Name: free fatty acid receptor 4
  Uniprot ID: Q5NUL3
  ENST ID: ENST00000371481
  CDS Start-End: 57-1142
agtcgcctcccagatgagcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagatcacaaaggcatcaaggaagaggctcacggtaagcctggcctactcggagagccaccagatccgcgtgtcccagcaggacttccggctcttccgcaccctcttcctcctcatggtctccttcttcatcatgtggagccccatcatcatcaccatcctcctcatcctgatccagaacttcaagcaagacctggtcatctggccgtccctcttcttctgggtggtggccttcacatttgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatcttaaaaaaaaaaaaaaaaagatttgttatgggttccttttaaatgtgaacttttttagtgtgtttgtaatatgatcaaatttaataaatatttatttatgactgttcagcaatcacatctcctacatataaagccacaccatagtggtttctgaagtgagtcttagaaccgattcaggacgcagatttctcctctgaagggtcacagccaccctgtgccctaccttggactcgcaagggtttaggatcattcgttgatgtcaagagcaattgaagaatttctaaggaacagttaaagatgacttacttttttttttttttcatttataaaaatgctatggacccttttaagagaatcggcatcatgaaatgagagagaaagtaggatggctctgaaatgtttgagagtgagttcaggagtggtttactcctgacgcatccagcagagatgcctcttaagcaccagccatggcagacagtgtcctttgtgctaggaatacagtggtgaaccagacagccatggccctctctcagggaacttaccttcgagtcaggggcagaaaaactaaataaaagtcaataaactatatctatatacagatacctatatatttgagatgagggtcttgctccaatgcccaggctggagtgcaacggcacaatcacggctccctgaagcctcaaatgccttggctcaagcaatcctcccgcctcagcctcccaagtagctgggattacaggcgtgagccgccacgcctggctacaagtcaataaatagtatagcatcacagagcgaataagcactgtgaagaaaatgggacgggggctatggtagtgatgggaatttagatcagatggggaggggcctaaggagacctttctgaggagtgacaaattggatcaaaaggtaagcgacaagaaagggccacctgtgtgaatgggggaagggacacagaagagatgttagtgcaaggaggctgacacgcttgaagggagagtggcgtaagccgactattgatggagcctcctctgcactaggcactgcctttaatgctgagatgaggggtacccggctggggcctgtcagttgaggccagagaaattgcagggttagatcacatagggcctaggagtttattctgttctccaagcccctggaggttggcaactggaggctgacgtgacctgatgaatgtgtgcaaagattaccctggctgctgggcagggaatagactctgaggagcatgagtgaaaatggagaccagttgggcagctgctgaagtgtgacatggggatgggaccttggaggtgagtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtga

SEQ ID NO: 135342 - DNA, 3653 bp, Homo sapiens
  Payload ID: 6450
  Gene Symbol: FFAR4
  Gene Name: free fatty acid receptor 4
  Uniprot ID: Q5NUL3
  ENST ID: ENST00000371483
  CDS Start-End: 57-1190
agtcgcctcccagatgagcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagacctcggaacacctcctggatgcaagagctgtcgtgactcacagtgagatcacaaaggcatcaaggaagaggctcacggtaagcctggcctactcggagagccaccagatccgcgtgtcccagcaggacttccggctcttccgcaccctcttcctcctcatggtctccttcttcatcatgtggagccccatcatcatcaccatcctcctcatcctgatccagaacttcaagcaagacctggtcatctggccgtccctcttcttctgggtggtggccttcacatttgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatcttaaaaaaaaaaaaaaaaagatttgttatgggttccttttaaatgtgaacttttttagtgtgtttgtaatatgatcaaatttaataaatatttatttatgactgttcagcaatcacatctcctacatataaagccacaccatagtggtttctgaagtgagtcttagaaccgattcaggacgcagatttctcctctgaagggtcacagccaccctgtgccctaccttggactcgcaagggtttaggatcattcgttgatgtcaagagcaattgaagaatttctaaggaacagttaaagatgacttacttttttttttttttcatttataaaaatgctatggacccttttaagagaatcggcatcatgaaatgagagagaaagtaggatggctctgaaatgtttgagagtgagttcaggagtggtttactcctgacgcatccagcagagatgcctcttaagcaccagccatggcagacagtgtcctttgtgctaggaatacagtggtgaaccagacagccatggccctctctcagggaacttaccttcgagtcaggggcagaaaaactaaataaaagtcaataaactatatctatatacagatacctatatatttgagatgagggtcttgctccaatgcccaggctggagtgcaacggcacaatcacggctccctgaagcctcaaatgccttggctcaagcaatcctcccgcctcagcctcccaagtagctgggattacaggcgtgagccgccacgcctggctacaagtcaataaatagtatagcatcacagagcgaataagcactgtgaagaaaatgggacgggggctatggtagtgatgggaatttagatcagatggggaggggcctaaggagacctttctgaggagtgacaaattggatcaaaaggtaagcgacaagaaagggccacctgtgtgaatgggggaagggacacagaagagatgttagtgcaaggaggctgacacgcttgaagggagagtggcgtaagccgactattgatggagcctcctctgcactaggcactgcctttaatgctgagatgaggggtacccggctggggcctgtcagttgaggccagagaaattgcagggttagatcacatagggcctaggagtttattctgttctccaagcccctggaggttggcaactggaggctgacgtgacctgatgaatgtgtgcaaagattaccctggctgctgggcagggaatagactctgaggagcatgagtgaaaatggagaccagttgggcagctgctgaagtgtgacatggggatgggaccttggaggtgagtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtga

SEQ ID NO: 135343 - DNA, 1142 bp, Homo sapiens
  Payload ID: 6450
  Gene Symbol: FFAR4
  Gene Name: free fatty acid receptor 4
  ENST ID: ENST00000604414
  CDS Start-End: 40-750
gcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagggtccccactggtgactgactttatgtgaatgagagatgagcttccactggatgaagctactgagatttgagaggttacctgtaacagaagttgctgttaccttaaccttcacagcatcaaacacatcactaactcctaaaaaagactgaaaagggttttaccataactcacagaactaatgcaagacatttgtgtccttaccctcatgaaaattaagcactagcaaccagctccattttatacaaagtaacatttatacccacatctggaccgaggccaagaaaaatgaaaaacaaggaagtggagcagcatttatcttctgactgcatttaaaagatgtcaaaataattggttgaaaaatggaaaggttagtcagtccatgttttcaggtacaaagagataaatt

SEQ ID NO: 135344 - DNA, 2649 bp, Homo sapiens
  Payload ID: 6451
  Gene Symbol: FRAT1
  Gene Name: frequently rearranged in advanced T-cell lymphomas 1
  Uniprot ID: Q92837
  ENST ID: ENST00000371021
  CDS Start-End: 188-1027
attccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctactgcagcagtcagtggcgctgggcagctcgggcgaggtggaccggctggtggcccagatcggcgagacgctgcagctggacgcggcgcagcacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgcgctgcgccctactgcgtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggactttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctc

SEQ ID NO: 135345 - DNA, 2213 bp, Homo sapiens
  Payload ID: 6452
  Gene Symbol: FRAT2
  Gene Name: frequently rearranged in advanced T-cell lymphomas 2
  Uniprot ID: O75474
  ENST ID: ENST00000371019
  CDS Start-End: 138-839
aggcgcgtggctcgagtgcctggcgggctccggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagtcatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaatttggcttttgttttgga

SEQ ID NO: 135346 - DNA, 6963 bp, Homo sapiens
  Payload ID: 6453
  Gene Symbol: FZD1
  Gene Name: frizzled class receptor 1
  Uniprot ID: Q9UP38
  ENST ID: ENST00000287934
  CDS Start-End: 518-2461
tccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactggctatgtgttcataaacattttaaacagcaattgggtttgtaaggctgttttgttgtttgcttctgaagacccctttttttaatcgttcaaggaaccttctccagataaattatctagttggtctactcttagtcagaatttatgcatgggtgtatatatgtgtatatatagataagtatacacataagtatatatgcattaatttttataaaatagagatgtaaagtttacttacatttcataatatggaaatatggttatgagaaatggaaaatgctagatggaaaacctcaaatacctttacaggttaaaaatatctttactaaattttcccatgaaaacattttgtgataaaatgacaagggactaaaatgaagatcattgatacaatagagttactttccttgttacaatgcaattgtcttataagtcattattcattttaaggaaaatcaaaaaaattagatcttactaaaaatgtagcatttgattttaagtagcaagatgcaattttgtgttccctttttctttgttacattaacataatatagtagatagagggtttattgtatagacatacacaaaaaaatagtattcttaggccaaattcacacatatctcctcactaagtagttcaattagataatttctggaaaaacatgtttttgacattaattgctatccaaaactatattttaaagcagtcttattggaggtgtccttaacatgatgtaactataaatttgatgcagaaaggttttacatgctgtggttaaatagctttagaagacatttttaagtcaccaccagcctttattcttagaaaacaatttattctaaatgatgatgcatatagaaaaccagtgtattcttttatttcttttaatactggtggcaaaataggacgtgtctggaaaaccataaggctacttgggatactgtcccattagcattgctgtttccatgacaaaccctattttcagatggtttgatttgcctattttttttttaaaccagctataaattggggtcaatttcccccctcacagtgtacttaatttagcttttggagtaaatatataagtagtatgaaagacttctgaagctcttctttctaaaaaagcagttttccacttaagctttgtggggacagagagtcatatttttaatttcagagccagccagtgtcaaacacgtgcaaaagagccgggccggattttttcagcttgtcctatggtagtcacttgtcagcctgagtttactggcctggtccttttgtctccactgtaagtactgaagccttctggtgtagttgtatcaccttaatgtccagcatttaactaggaaaggagactacaatgaagagttggtggccaattaagaaaaataatagactacatcataaatcatttcaggacttgagtggccgcagatcactgtccctgatagcatgtttcaaccttggtatacattttttttaagatgcatatttactgtgtgtgcttttgctttctaatccatctattgactattggccacaatttatataatgcacatgcaattaattgaaacctgtgtcatggcattggatatctctgattcatttcttattataatagtctgtgtaactggggcctgagagattagaagcaaaatgtagtcgtacgtatgtctagaggtggacgctggtgatattgtcattgaatactttgcagaatacactaatgtcaaaggcttgcaggattaatgtgtaggaaccaacataagacatggaatatatataagaattatctagttacatgactaaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaa

SEQ ID NO: 135347 - DNA, 3281 bp, Homo sapiens
  Payload ID: 6454
  Gene Symbol: FZD10
  Gene Name: frizzled class receptor 10
  Uniprot ID: Q9ULW2
  ENST ID: ENST00000229030
  CDS Start-End: 485-2230
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgct

SEQ ID NO: 135348 - DNA, 3282 bp, Homo sapiens
  Payload ID: 6454
  Gene Symbol: FZD10
  Gene Name: frizzled class receptor 10
  ENST ID: ENST00000539839
  CDS Start-End: 583-1947
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgcta

SEQ ID NO: 135349 - DNA, 2112 bp, Homo sapiens
  Payload ID: 6455
  Gene Symbol: FZD2
  Gene Name: frizzled class receptor 2
  Uniprot ID: Q14332
  ENST ID: ENST00000315323
  CDS Start-End: 231-1928
cagcgcgcggtgtctccggctgctcagtccgaccgcggcaagcaagcgggcaggcgcaccgccccctcccccgcccggcctccccaactctgcggccgcgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacacccccacaaggtttgtaattaaaactgtaaatagtc

SEQ ID NO: 135350 - DNA, 13736 bp, Homo sapiens
  Payload ID: 6456
  Gene Symbol: FZD3
  Gene Name: frizzled class receptor 3
  Uniprot ID: Q9NPG1
  ENST ID: ENST00000240093
  CDS Start-End: 479-2479
gccgctccgggtacctgagggacgcgcggccgcccgcggcaggcggtgcagcccccccaccccttggagccaggcgccggggtctgaggatagcatttctcaagacctgacttatggagcacttgtaacctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattcagggtttggattagcagtggaataaagagatgggcattgtttcccctataattgtgctgtttttataacttttgtaaatattactttttctggctgtgtttttataacttatccatatgcatgatggaaaaattttaatttgtagccatcttttcccatgtaatagtattgattcatagagaacttaatgttcaaaatttgctttgtggaggcatgtaataagataaacatcatacattataaggtaaccacaattacaaaatggcaaaacattttctctgtattcattgttgtatttttctacagtgagatgtgatcttgccaaagccaccagaccttggcttccaggccctcctgtagtgagttgattgtctgcacttgccttgcccaatagccagtaggctacagcttttgccccacacccttattttcagattctggatcattcttgtttacaactgaaatatatataacctcagtccaaagtggtgattgatttgagtatttgaaaattgttgtagctaaatgaagcatgattagtcttagtatgaatatcatttaatctttaaaaaatcaagtaaaaatgtttatctgataatgtttaaataatttacaatataaactgtaaaacttattaggcatgaaatcaatcagaagagaaagaaaaatgctggaacatgcttgatgtattatgtaaaaagcatatttaaacaagggtcctcaaccctgactgcagataagaatcacttgggttacttcagatgcctaacaccttcctctcatacaaataagaattggtagctttcttaaaaaaaaaaaaaaaaaaaaaaagcgctccaggtgattctaatctgcagcctggcttgaaactcactactttaacttgcccctgatgatctgtcggcatcatatatcacatgaacatccacatggattctgtctttcgcttttatatcattatctaatattcagttgttctgcacctgatgccaaattctgggctgtactcctagagagacttactcagtaaggccaaagtgataggactttaaaatctgtagttataaaaataccgcaggtgattcttacggaggtaatccaagaatcatactttgaagaattattctagactctgaagaggcctggctctgccttatgctattatagtttatgacctttaacaatttaactctccgagcctcagttcccttgtttgtaaatgaagatagaagataaatacgtactctacctacctcacaaagctgtcagattaagatcaagtgaaaaaaattatgtgaaagctctttgaaaactgtaaagcattatgaatgataagggattaggttattgtggatttaagaggtgtgaggactgctatagtacattccttgacgtgtgttgaattcatgtatactttctttcttaccctttaaaacaaactgccaagaaattaggtgttgaaaaagaatattctcatcaggcagcaaagtcagttttctgatagtaataatttgtctattatgttatatatttcaaagtacatgtatgataatatgacttattcttcatgagagatatttgaatatttggcccaaaatgtttttcatttttctctgtgttcattgcctttctccttggagctggagttaatgctcaaagcaggcaggtctgaattccctcataaccgacaattagtaaacattttctctgaaagccaaacatataacaacttatttatcaataattcatgaagcttttgtctgagaatctctcctgcaaacagcatgagagaactaaaacaaacattcacaaacaaaaataagttaaaatagaaggtaccagtttgggctcgaagatgttgtcatccattgccatctgcattatattatcaactgccaaaatgttaattggttttcttttacaagtgggccaagtatagacagttaagtgaacatcactatgaaaatcttaactttgtgcttctagatttttagataatcatttgtattttctctattaaattgtgggtatgtatgggaatactatattgacttttcagttactttcagtaagtatcttaattttgtcccacaaaatttatgtaatattaatccatggttttaaacaacagtattcagtttgggcagcagttttaagtctaactagcttaaaccaatctgaataagtctggacagttttcctaccatatgtttaactttgattggcatatgataatgtttagtgttttcttttttcagttgacaactgagaaaataatagttctctctaacatgttaatatattatcaaaaggttttcaaaaagtactttgatttcagcaactttttttattcaataactagacaaaagatctaagataatattaaactcaaaacagtttgtttcaaagaacaattggttaataactcagctggcacagggattcatacacagtttttcaataaatatttaaatgaacaattcatgtcacacaacttgcttttaccctagtactgagtctcacatcaaagaaatttgaaagatctataacctatgtgaaatgaagtctctgctttaccagaataatatgtggcaggtaataaatatgtaaagtacaccaaatgaaacatattttgcatagataacagtccatatcactattataattaaagaaatatatgtacagacatgtaccaatccttttaattaattttagaagatgaacagtgattcttagaagtgagtaattagactccttttagtcttatgctgttagatctttgtggaccagctgagtaaatgaatcttcaaatcaacctttctttttctgctgctcttagagcagatttataaaaatcctaagaatgtcttcaaattagaaaaatttactacattttaacctacctcatcagtttctttgtgataatagctgaaaataactcaaactgtacccatcttagttaggctatatctctgtgaaatgaaaggaaccacttaattttttttatataaattagtgaatcatttgctggagcttagaaaatattaacataccaaaatttcattatgatgatatttatattgctttttgacatgccaaaggtacatttacatattaccatatttggatgacttacatagtctggtgtaatgaaaattcccctgggattggaattttaagactcatgatgtcaactgggctggtcattttatttctctgagtctttgtttcttcaatgtaaaatgtggataaggtaatttttggttttagcctccctcactggatattgtaaggatcaaatgaaatagtatttattataatgctctgtaacccataaattattctacttaaaaaaattttttatagagacagggtcttgctctgtcacacaggctggagagcagtggcataatcatagttcattataaccttgaactcctaggctcaagcagtcctccagcttcagcctcccaagtagctaagactgtaggcatgcaccactacacctggctaattttaatttttttttctttttttgagacggagtctggctttgttgcccaggctggagtgcagtggcacaatctcagctcactgcaacctccacctcccaggttcaagtgattcttctgtctcagcctcccgagtaactgggactacaggtgcgtgccaccacatccagctagtttttgtatttttagtggagatggagttttgccatgttggtctcaaactcctgacctcaagtgatctgcccacctcagcctcccaaagtgctaggattacaggcatgagtcactgcacctggcttaattttaatttttttaattttttgtagagatgagtctcactatgttgaccaggctggtcttgaactcctggcctcctaaagcactgggattacaagcatgagccaccatgcctgatccataaattgttctactgataccatttggttttgttagaatttgggggggctatagaaaacaaggttacagtcttcattagtatttctttttagcaataacaacaaaataggcaattagaccagtgttcatttggtacagtctttaaatcggtcatccaattaacctttaaaaagtaggttatgctcttaaattgtattggttctttaatatgtgttataccagagtatgcctcaaattttatgtagttgaatttgtagaacaaatttggggatattcattttatttttccttttatatgaaattgtataagtacattagcttgacttaaattataaaaaaaaatatatatgaagaagaatgtagaccctataatgttttttgtctttgactttttggcttttatgtacctcattttttctgattgagaaaaagttttgaaaaagtgattcacttgttggttttcattgtggcaaaactttaaattttaagtcatcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttatatgaaaataattgtattggcatctcttcataatttaattctcttctctccttcttttgttccgattagatgaatttgggaaaggagtaggaagactaggtatcgcatgccttccgtctgattgtaatcagtctcctgggttttttactaatttaatcttaatcctgtgcttctttagtcatcaaattgatataggattacaattttctctcaggatccaagtcttctaagaatgaaaatgttgaagtctacccagaaccagccatccttgtagacatttctatttggttgatttataaagatttaatatataaagatttaatatgagttaaacatgtttcttattctgtgatctctaattagaaagtaaaattctgttgccataaatataaaagaaagttttcacttatattttagtcaaacaccaaaccactgcattacttacttcctataagacacagtagttcaatctgttgaaaggcattgaaggataatttccttcagattactttttaaatcatcatctgcctcaggaaattctttcttgaatttttttgttggtgtgaaagcgttgcttatactttatgctcattttattggtcactgtcaccagtttttcccgataaagattaaaaatgttttttaccttgaaataattcagattttgaagattcactgtttcattattttgctaattaccattaactagtaaagttagtttttaaagtttttttaaggttgatattttatcatattcctggagtaggatggattactttattattattgtagctttaaggttttttgttgtataagtcagcttgtttgtatatgctaaattgcagatatttctttgtgttgtgcttattggtttttttttttaacttagagcttaataatttctattttctatcctggagtctaaaattaaacaaaaaaatctattttctaaattggcaggatttttttaatgattagtaaaactgtattattttatttttaaaaatacaataggattttgagtcaggaaacttgacttctactcttgcctctcttttgcagttagctgtgtaactttggataaggcattttatctcgtggtgcctccatttttctcattctctagggaacaagagaattagtttaggtagcgtctaaaattccgcccagctctcatttggttctcatttgaccattttataatcattattttggtctcatttttattcttcttattcatcccatgaactagatcaacttgtattattttactagatcaacctgtattattaacgtcatttacatgtaaattgatgggattcagatattttatcaactgtttttccattagtgattttaagtaattttaaagaaggaaaattatattacagataataaaaatgaaagaaagttataaatattggacatggcttttttaaatgggaaagtcttcttaagcaccaatataagcaccttaaattgatacatagaaaagaatgacataacgttttgtggtctttgttctcttaaatatgaatatagctagttagcctaaaatttacacaaaatgtattcaagatcaaattagtgaacaaagcaatggttcgtatggctaatttaaaagcaattcaatttaccaatattaaaataattataaaatgtaaaagaaatttcagaggagttgattgaaaattttttgttcagtaattattcttaaactgcattcttaggtttattacataaatatagttgccagattgccatgggcaagtgaatgtcttcatttgaaatattattagagatcaatgtggcttgttatttttaatttttttctggctatacagaaaatgtttctggaaaaattccttaattgtcatctgatataatgtagagattgaggccagacgcagtggctcacgcctgtaatcccagcactttgggaggccaaggtgggcagatcacctgaggtcaggagttcgagaccagcctgatgaacatggcaaatccccttctgtactaaaaatacaaaaattagccaggcgcagtggctcacgcctgtaatcccaacactttgggaggccgaggcgggcggatcacgaggtcaggagatcaagaccgtcctggctaacatggtgagaccctgtctctactaaaaacaaaaaaattagttgggcatggtggcgggcacctgtagtcccagccactcgggaggctgaggcaggagaatggcgtgaacccgggaggcggagcttgcagtgagctgagatcgcaccgctgcactccagcctgggcaacggagcgagactctatctcaaaaaaaaaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaaaaaaaaaaagaaaaggtttgtttttagttctctgcctctgcaagtctttgtgatcacatttgttaaattgaatctgagattcaaatatttcatttaatattttctgggttttgataatgggatattctgtaagataaagcaagtaatcctagagtgatttactttatgtttagccatccaccattttcctatttctctactcctcccattctccatttttaaaaggaaattaacaaatgtcttcctttatccctgcctcagataatttttccctgaactcatcttgtcagcagaaacatttaatgtgaaataattctgtatttctgagacaagatcaacacagtagttctttacattgagctgaggtgaatgtatacttaaaaatactctattttctttttatatgaacttaaaatttttaaaatcatatatgggactccccaatgtgaaaatattagtctggacattctcttgccatcaggtgctatttctaccttagctgtgagttagactaaatccaaatttcgtatcattcatctttttataatatttaacttccctagaatcaccccatttcatgtctttaaccccaacttccaacaacttttctgcttttattttcaaatgtcaaattgtatttttgtgttttattttctcattgaagtgtaaaagtatcacatatatgaaggaatggctggtttagacatttactttggcatagtaaagattgatattgataccacccaccatcctttcctctagccccagaaagaaaagtttgacaactcaaaaacgattaaattatcttatcttgttatttaatagaacaatggaagctgtttcgtcaaaattaaaatactttaccaaaaaaatacttttttgtattttaatctgatagtgaatttggggattatttatgtaaatgtatcataattaatagtaattatgagttatttcactctctgtaatttgtgatacccaagattcatatttatttaatgtgaggtgttttttgaggcttttttgttttatcttgttttcttaactttttacagtgttgttagattatcgcggtcatctcggcatgtggatcgctcctcctgtagatcagctgttctctcttagagtcaggacaaggaggtttttgctacatggtcgtagttggataatacagcattattctgaactatctgaaattgctggttttattggtcaaaaatgatcagatgctagcaatttcataatagatatattcaagaaggaaccaaactttaaaagatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgtaagtatcatttagaggcaaaataatttccccctcacatctaatgtggactcaaattttggcaactggaatgttatcctcttggtaggcattctaaattaatgaatactgctatgtggtgtagtaaacaaatttgccataaaatgccatttaaggattttctttttacctttatttcattataaaagtatatgagttgaagatcatataaaaaatatgaaactcctacacaggaaatccccaattttgtgatttaataggttgtaaaaagagttgttccaaattcagactacatctcatcatataaataatattatgaataataagggtaaaagattagccaacaaaagctaatctagtacaccccatagaggtactccaggtgtcttggttttggataaatttttatagtggagaaaggttactttgatctctcaataattgcttggtacacttcttcctaggcaatatgctcatgataccctcttcatgtgacctattcctcaaatgctgcattctccaaaacttccttacctgccttctatcccctagtcattcttatcaatacttccaaaatataacctatctcaagtgttagaaatttgctttaactaatttatattaaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacatatgaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctcttttctgtca

SEQ ID NO: 135351 - DNA, 580 bp, Homo sapiens
  Payload ID: 6456
  Gene Symbol: FZD3
  Gene Name: frizzled class receptor 3
  ENST ID: ENST00000523546
  CDS Start-End: 475-580
gaaagctcgctgtcgctgggaggcgcgcgccggcgttcctcggccgctccgggtacctgagggacgcgcggccgcccgcggcaggcggtgcagcccccccaccccttggagccaggcgccggggtctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgt

SEQ ID NO: 135352 - DNA, 13740 bp, Homo sapiens
  Payload ID: 6456
  Gene Symbol: FZD3
  Gene Name: frizzled class receptor 3
  Uniprot ID: Q9NPG1
  ENST ID: ENST00000537916
  CDS Start-End: 484-2484
ggtgctcgcgaaagctcgctgtcgctgggaggcgcgcgccggcgttcctcggccgctccgggtacctgagggacgcgcggccgcccgcggcaggcggtgcagcccccccaccccttggagccaggcgccggggtctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattcagggtttggattagcagtggaataaagagatgggcattgtttcccctataattgtgctgtttttataacttttgtaaatattactttttctggctgtgtttttataacttatccatatgcatgatggaaaaattttaatttgtagccatcttttcccatgtaatagtattgattcatagagaacttaatgttcaaaatttgctttgtggaggcatgtaataagataaacatcatacattataaggtaaccacaattacaaaatggcaaaacattttctctgtattcattgttgtatttttctacagtgagatgtgatcttgccaaagccaccagaccttggcttccaggccctcctgtagtgagttgattgtctgcacttgccttgcccaatagccagtaggctacagcttttgccccacacccttattttcagattctggatcattcttgtttacaactgaaatatatataacctcagtccaaagtggtgattgatttgagtatttgaaaattgttgtagctaaatgaagcatgattagtcttagtatgaatatcatttaatctttaaaaaatcaagtaaaaatgtttatctgataatgtttaaataatttacaatataaactgtaaaacttattaggcatgaaatcaatcagaagagaaagaaaaatgctggaacatgcttgatgtattatgtaaaaagcatatttaaacaagggtcctcaaccctgactgcagataagaatcacttgggttacttcagatgcctaacaccttcctctcatacaaataagaattggtagctttcttaaaaaaaaaaaaaaaaaaaaaaagcgctccaggtgattctaatctgcagcctggcttgaaactcactactttaacttgcccctgatgatctgtcggcatcatatatcacatgaacatccacatggattctgtctttcgcttttatatcattatctaatattcagttgttctgcacctgatgccaaattctgggctgtactcctagagagacttactcagtaaggccaaagtgataggactttaaaatctgtagttataaaaataccgcaggtgattcttacggaggtaatccaagaatcatactttgaagaattattctagactctgaagaggcctggctctgccttatgctattatagtttatgacctttaacaatttaactctccgagcctcagttcccttgtttgtaaatgaagatagaagataaatacgtactctacctacctcacaaagctgtcagattaagatcaagtgaaaaaaattatgtgaaagctctttgaaaactgtaaagcattatgaatgataagggattaggttattgtggatttaagaggtgtgaggactgctatagtacattccttgacgtgtgttgaattcatgtatactttctttcttaccctttaaaacaaactgccaagaaattaggtgttgaaaaagaatattctcatcaggcagcaaagtcagttttctgatagtaataatttgtctattatgttatatatttcaaagtacatgtatgataatatgacttattcttcatgagagatatttgaatatttggcccaaaatgtttttcatttttctctgtgttcattgcctttctccttggagctggagttaatgctcaaagcaggcaggtctgaattccctcataaccgacaattagtaaacattttctctgaaagccaaacatataacaacttatttatcaataattcatgaagcttttgtctgagaatctctcctgcaaacagcatgagagaactaaaacaaacattcacaaacaaaaataagttaaaatagaaggtaccagtttgggctcgaagatgttgtcatccattgccatctgcattatattatcaactgccaaaatgttaattggttttcttttacaagtgggccaagtatagacagttaagtgaacatcactatgaaaatcttaactttgtgcttctagatttttagataatcatttgtattttctctattaaattgtgggtatgtatgggaatactatattgacttttcagttactttcagtaagtatcttaattttgtcccacaaaatttatgtaatattaatccatggttttaaacaacagtattcagtttgggcagcagttttaagtctaactagcttaaaccaatctgaataagtctggacagttttcctaccatatgtttaactttgattggcatatgataatgtttagtgttttcttttttcagttgacaactgagaaaataatagttctctctaacatgttaatatattatcaaaaggttttcaaaaagtactttgatttcagcaactttttttattcaataactagacaaaagatctaagataatattaaactcaaaacagtttgtttcaaagaacaattggttaataactcagctggcacagggattcatacacagtttttcaataaatatttaaatgaacaattcatgtcacacaacttgcttttaccctagtactgagtctcacatcaaagaaatttgaaagatctataacctatgtgaaatgaagtctctgctttaccagaataatatgtggcaggtaataaatatgtaaagtacaccaaatgaaacatattttgcatagataacagtccatatcactattataattaaagaaatatatgtacagacatgtaccaatccttttaattaattttagaagatgaacagtgattcttagaagtgagtaattagactccttttagtcttatgctgttagatctttgtggaccagctgagtaaatgaatcttcaaatcaacctttctttttctgctgctcttagagcagatttataaaaatcctaagaatgtcttcaaattagaaaaatttactacattttaacctacctcatcagtttctttgtgataatagctgaaaataactcaaactgtacccatcttagttaggctatatctctgtgaaatgaaaggaaccacttaattttttttatataaattagtgaatcatttgctggagcttagaaaatattaacataccaaaatttcattatgatgatatttatattgctttttgacatgccaaaggtacatttacatattaccatatttggatgacttacatagtctggtgtaatgaaaattcccctgggattggaattttaagactcatgatgtcaactgggctggtcattttatttctctgagtctttgtttcttcaatgtaaaatgtggataaggtaatttttggttttagcctccctcactggatattgtaaggatcaaatgaaatagtatttattataatgctctgtaacccataaattattctacttaaaaaaattttttatagagacagggtcttgctctgtcacacaggctggagagcagtggcataatcatagttcattataaccttgaactcctaggctcaagcagtcctccagcttcagcctcccaagtagctaagactgtaggcatgcaccactacacctggctaattttaatttttttttctttttttgagacggagtctggctttgttgcccaggctggagtgcagtggcacaatctcagctcactgcaacctccacctcccaggttcaagtgattcttctgtctcagcctcccgagtaactgggactacaggtgcgtgccaccacatccagctagtttttgtatttttagtggagatggagttttgccatgttggtctcaaactcctgacctcaagtgatctgcccacctcagcctcccaaagtgctaggattacaggcatgagtcactgcacctggcttaattttaatttttttaattttttgtagagatgagtctcactatgttgaccaggctggtcttgaactcctggcctcctaaagcactgggattacaagcatgagccaccatgcctgatccataaattgttctactgataccatttggttttgttagaatttgggggggctatagaaaacaaggttacagtcttcattagtatttctttttagcaataacaacaaaataggcaattagaccagtgttcatttggtacagtctttaaatcggtcatccaattaacctttaaaaagtaggttatgctcttaaattgtattggttctttaatatgtgttataccagagtatgcctcaaattttatgtagttgaatttgtagaacaaatttggggatattcattttatttttccttttatatgaaattgtataagtacattagcttgacttaaattataaaaaaaaatatatatgaagaagaatgtagaccctataatgttttttgtctttgactttttggcttttatgtacctcattttttctgattgagaaaaagttttgaaaaagtgattcacttgttggttttcattgtggcaaaactttaaattttaagtcatcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttatatgaaaataattgtattggcatctcttcataatttaattctcttctctccttcttttgttccgattagatgaatttgggaaaggagtaggaagactaggtatcgcatgccttccgtctgattgtaatcagtctcctgggttttttactaatttaatcttaatcctgtgcttctttagtcatcaaattgatataggattacaattttctctcaggatccaagtcttctaagaatgaaaatgttgaagtctacccagaaccagccatccttgtagacatttctatttggttgatttataaagatttaatatataaagatttaatatgagttaaacatgtttcttattctgtgatctctaattagaaagtaaaattctgttgccataaatataaaagaaagttttcacttatattttagtcaaacaccaaaccactgcattacttacttcctataagacacagtagttcaatctgttgaaaggcattgaaggataatttccttcagattactttttaaatcatcatctgcctcaggaaattctttcttgaatttttttgttggtgtgaaagcgttgcttatactttatgctcattttattggtcactgtcaccagtttttcccgataaagattaaaaatgttttttaccttgaaataattcagattttgaagattcactgtttcattattttgctaattaccattaactagtaaagttagtttttaaagtttttttaaggttgatattttatcatattcctggagtaggatggattactttattattattgtagctttaaggttttttgttgtataagtcagcttgtttgtatatgctaaattgcagatatttctttgtgttgtgcttattggtttttttttttaacttagagcttaataatttctattttctatcctggagtctaaaattaaacaaaaaaatctattttctaaattggcaggatttttttaatgattagtaaaactgtattattttatttttaaaaatacaataggattttgagtcaggaaacttgacttctactcttgcctctcttttgcagttagctgtgtaactttggataaggcattttatctcgtggtgcctccatttttctcattctctagggaacaagagaattagtttaggtagcgtctaaaattccgcccagctctcatttggttctcatttgaccattttataatcattattttggtctcatttttattcttcttattcatcccatgaactagatcaacttgtattattttactagatcaacctgtattattaacgtcatttacatgtaaattgatgggattcagatattttatcaactgtttttccattagtgattttaagtaattttaaagaaggaaaattatattacagataataaaaatgaaagaaagttataaatattggacatggcttttttaaatgggaaagtcttcttaagcaccaatataagcaccttaaattgatacatagaaaagaatgacataacgttttgtggtctttgttctcttaaatatgaatatagctagttagcctaaaatttacacaaaatgtattcaagatcaaattagtgaacaaagcaatggttcgtatggctaatttaaaagcaattcaatttaccaatattaaaataattataaaatgtaaaagaaatttcagaggagttgattgaaaattttttgttcagtaattattcttaaactgcattcttaggtttattacataaatatagttgccagattgccatgggcaagtgaatgtcttcatttgaaatattattagagatcaatgtggcttgttatttttaatttttttctggctatacagaaaatgtttctggaaaaattccttaattgtcatctgatataatgtagagattgaggccagacgcagtggctcacgcctgtaatcccagcactttgggaggccaaggtgggcagatcacctgaggtcaggagttcgagaccagcctgatgaacatggcaaatccccttctgtactaaaaatacaaaaattagccaggcgcagtggctcacgcctgtaatcccaacactttgggaggccgaggcgggcggatcacgaggtcaggagatcaagaccgtcctggctaacatggtgagaccctgtctctactaaaaacaaaaaaattagttgggcatggtggcgggcacctgtagtcccagccactcgggaggctgaggcaggagaatggcgtgaacccgggaggcggagcttgcagtgagctgagatcgcaccgctgcactccagcctgggcaacggagcgagactctatctcaaaaaaaaaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaaaaaaaaaaagaaaaggtttgtttttagttctctgcctctgcaagtctttgtgatcacatttgttaaattgaatctgagattcaaatatttcatttaatattttctgggttttgataatgggatattctgtaagataaagcaagtaatcctagagtgatttactttatgtttagccatccaccattttcctatttctctactcctcccattctccatttttaaaaggaaattaacaaatgtcttcctttatccctgcctcagataatttttccctgaactcatcttgtcagcagaaacatttaatgtgaaataattctgtatttctgagacaagatcaacacagtagttctttacattgagctgaggtgaatgtatacttaaaaatactctattttctttttatatgaacttaaaatttttaaaatcatatatgggactccccaatgtgaaaatattagtctggacattctcttgccatcaggtgctatttctaccttagctgtgagttagactaaatccaaatttcgtatcattcatctttttataatatttaacttccctagaatcaccccatttcatgtctttaaccccaacttccaacaacttttctgcttttattttcaaatgtcaaattgtatttttgtgttttattttctcattgaagtgtaaaagtatcacatatatgaaggaatggctggtttagacatttactttggcatagtaaagattgatattgataccacccaccatcctttcctctagccccagaaagaaaagtttgacaactcaaaaacgattaaattatcttatcttgttatttaatagaacaatggaagctgtttcgtcaaaattaaaatactttaccaaaaaaatacttttttgtattttaatctgatagtgaatttggggattatttatgtaaatgtatcataattaatagtaattatgagttatttcactctctgtaatttgtgatacccaagattcatatttatttaatgtgaggtgttttttgaggcttttttgttttatcttgttttcttaactttttacagtgttgttagattatcgcggtcatctcggcatgtggatcgctcctcctgtagatcagctgttctctcttagagtcaggacaaggaggtttttgctacatggtcgtagttggataatacagcattattctgaactatctgaaattgctggttttattggtcaaaaatgatcagatgctagcaatttcataatagatatattcaagaaggaaccaaactttaaaagatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgtaagtatcatttagaggcaaaataatttccccctcacatctaatgtggactcaaattttggcaactggaatgttatcctcttggtaggcattctaaattaatgaatactgctatgtggtgtagtaaacaaatttgccataaaatgccatttaaggattttctttttacctttatttcattataaaagtatatgagttgaagatcatataaaaaatatgaaactcctacacaggaaatccccaattttgtgatttaataggttgtaaaaagagttgttccaaattcagactacatctcatcatataaataatattatgaataataagggtaaaagattagccaacaaaagctaatctagtacaccccatagaggtactccaggtgtcttggttttggataaatttttatagtggagaaaggttactttgatctctcaataattgcttggtacacttcttcctaggcaatatgctcatgataccctcttcatgtgacctattcctcaaatgctgcattctccaaaacttccttacctgccttctatcccctagtcattcttatcaatacttccaaaatataacctatctcaagtgttagaaatttgctttaactaatttatattaaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacatatgaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctcttttctgtc

SEQ ID NO: 135353 - DNA, 7383 bp, Homo sapiens
  Payload ID: 6457
  Gene Symbol: FZD4
  Gene Name: frizzled class receptor 4
  Uniprot ID: Q9ULV1
  ENST ID: ENST00000531380
  CDS Start-End: 307-1920
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaatttttatgtctttgttggtgggcatcacttcaggcatgtggatttggtctgccaaaactcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggcgttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgtta

SEQ ID NO: 135354 - DNA, 6708 bp, Homo sapiens
  Payload ID: 6458
  Gene Symbol: FZD5
  Gene Name: frizzled class receptor 5
  Uniprot ID: Q13467
  ENST ID: ENST00000295417
  CDS Start-End: 555-2312
ctcccggccccggggagaacgcacggcctgcccctgcccggctccgtctggatcatgcggggggctcccgaggaggagagggcgagtgaccggcctgcgccgcccctgttctgggggcgccccccactctgagtcgcccccacctgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctagcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggaacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccggcatgaagtggggcaacgaggccatcgcgggctacgcgcagtacttccacctggctgcgtggctcatccccagcgtcaagtccatcacggcactggcgctgagctccgtggacggggacccagtggccggcatctgctacgtgggcaaccagaacctgaactcgctgcgcggcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtctttaaaaaaaaatgtgaacagtgaacgtttcggttgctgtgactgggaagttgttgggtgtgctttttcagccagcttctccttccactgcttaaagtgtccatgattctttaaggtgagctgcagtttatagccccaggtcatacctaggaggggagcataatgagctcagggcctccccaaagtgacaaggttagggagtgcttagcggttttgtgttcagccttagctttgtttatagagggaggttcagtttcttttctgtagtgcttgtaataattctcactcctaacagcaccatcgttgtgtcttgaataagttagaggtagcattatagaggatctggcataaatatttgcagtagtgagagcctaagcgatggtgattggtggagcttgaattttaggctggtgagatggcagctttgtgcctgagaggtagtgggtggttcttaagcttcagtgatcccctttttttttttttttttttttttttaaggaacttgtgttataattttggtaaaagtataaacccactccctctggacaatacttagcgacagttgctaaagggggctcctttttaaatgtaaggactgaaatggatatacttctaataagtaaatttccaacacttatttgctccaccccctcccccctcccccctccccctttatcatgttaaacagcctttttgcttttcttattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagcccacctgcatccctaagtcttactgagatcagccaccccaggggagagaaactggatctacttacagccaccccctgtttccatccatatagttacttcccccaatttgcatgtgattatggaaacaagtcatgctcatgaaagcaactgtaaaataaaaggttatggagtagttcagcaacttcttcacagccagctttgtggagctggggaggacttagggcccattggagtctcttatgtgtacagcttcagggctgtccctttcagtttgattttaagcaatgcctcacttcatagcttagggggtaaggattccattcaggtaggttgtctaaaggaactaatgggacctctcagtgaattagctgaccagattttaggaaatctttttaatttctatgattttccttctcacattttgaaatggtaaaattgactggaaataatttttcttggtgccttattggttttccttgcaaacctttctcatattttctcatgaccattgccagtgaccaaggcccatgtgtgtgttgtgtgtaattgtgggcatgtacaagcttaaataacgtgccgacagcactgtttcaaagttggtattcattaggctgttgcctcctgggctggagctgcgctaatcctgacaccggctgccaggagaaaacctcatggatcacacaccaaaccttaataacagcatccgtgacctgcactctccagtacagaatgggaaccccagagctaggaaatgtagttgtatattttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaa

SEQ ID NO: 135355 - DNA, 3788 bp, Homo sapiens
  Payload ID: 6459
  Gene Symbol: FZD6
  Gene Name: frizzled class receptor 6
  Uniprot ID: O60353
  ENST ID: ENST00000358755
  CDS Start-End: 318-2438
gacctggcggcgcagtctcgcgggatcgctcagctctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgt

SEQ ID NO: 135356 - DNA, 2006 bp, Homo sapiens
  Payload ID: 6459
  Gene Symbol: FZD6
  Gene Name: frizzled class receptor 6
  ENST ID: ENST00000519011
  CDS Start-End: 273-455
gtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttg

SEQ ID NO: 135357 - DNA, 2682 bp, Homo sapiens
  Payload ID: 6459
  Gene Symbol: FZD6
  Gene Name: frizzled class receptor 6
  ENST ID: ENST00000521195
  CDS Start-End: 155-349
agtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagggtacccagactggttaagcagaaaaggaattgattataagagtagcaggtagctcatagaatcgccaggtgggctagaattcaagctcaggctgtaaggaaacatgctacagctaagatgctggcacagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatg

SEQ ID NO: 135358 - DNA, 1472 bp, Homo sapiens
  Payload ID: 6459
  Gene Symbol: FZD6
  Gene Name: frizzled class receptor 6
  ENST ID: ENST00000523933
  CDS Start-End: 265-567
tctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtgatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcct

SEQ ID NO: 135359 - DNA, 3646 bp, Homo sapiens
  Payload ID: 6459
  Gene Symbol: FZD6
  Gene Name: frizzled class receptor 6
  ENST ID: ENST00000522484
  CDS Start-End: 318-1721
gacctggcggcgcagtctcgcgggatcgctcagctctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcagtccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaa

SEQ ID NO: 135360 - DNA, 3719 bp, Homo sapiens
  Payload ID: 6459
  Gene Symbol: FZD6
  Gene Name: frizzled class receptor 6
  Uniprot ID: O60353
  ENST ID: ENST00000522566
  CDS Start-End: 291-2411
cctttcgaactcaagtcacttgggcaattggctttacaaagcaaattggctccgtttaaggattcttgactcctgaaatccgcaaggaagtgggttcttttagagccagcgccaagagcttcaaaaaatccttctaagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaa

SEQ ID NO: 135361 - DNA, 2774 bp, Homo sapiens
  Payload ID: 6459
  Gene Symbol: FZD6
  Gene Name: frizzled class receptor 6
  Uniprot ID: O60353
  ENST ID: ENST00000523739
  CDS Start-End: 265-2289
tctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtgatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacattcttcttttgcacttaaagttgcattgcctactgttatactggaaaaaatagagttcaagaataatatgactcatttcacacaaaggttaatgacaacaatatacctgaaaacagaaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcacttt

SEQ ID NO: 135362 - DNA, 3859 bp, Homo sapiens
  Payload ID: 6460
  Gene Symbol: FZD7
  Gene Name: frizzled class receptor 7
  Uniprot ID: O75084
  ENST ID: ENST00000286201
  CDS Start-End: 62-1786
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaatgaa

SEQ ID NO: 135363 - DNA, 4030 bp, Homo sapiens
  Payload ID: 6461
  Gene Symbol: FZD8
  Gene Name: frizzled class receptor 8
  Uniprot ID: Q9H461
  ENST ID: ENST00000374694
  CDS Start-End: 850-2934
gggaagttgggctaagggcgctgctcccgccgaggaggaggcggcggctgggcgcgggccgcgccactcaggtgtccgctccgccttccggtctggatttgctcctgggtgtccagcaggaaggagactgtgtgcacctcgcccgactgcggccggagcgcggcgctgacttttccaggcggcgggggtccgtctgtcccggcggcggacggacgaaggacggacgccggagaaagagggcggcggcctgggccgaggcgggtccccaactccggcggcggcggcggcggcttggccttgggggcgggcatgagcccccgggggccgagtggtggccgccagggctgacccggcgcggcaagcggcccggcccagccatcttgactgcgcaccgcggccccagaggaaacttgcggcgcctccgccctctctgtccggcggagtcaccgccgcccggcgcggcggggagaagtggtcgggcgcgcggagaggaggcgagcgagcgcgggacgatgagccgaggcccggccgctctgcgccgcgagggctgagcgcgacccggggccagcagagcggacctacggactgtggcgcgcgcctgcagccgccttcaaacccccggagcggcggaaaggagtgcggaagggccctgcccaggctgcgggccgcgccgctgcggacgcgcccctagaaggggttagattatcggcagacccccctcccgggcgaagcataagggagaccccagatcacccgctgtacccgtctgcggctctctcgtgggccccccccccggcacccctctgcgcgccgcctggagggcgagggcaccgggccgaggcgcacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggcggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctcttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagagccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctg

SEQ ID NO: 135364 - DNA, 2338 bp, Homo sapiens
  Payload ID: 6462
  Gene Symbol: FZD9
  Gene Name: frizzled class receptor 9
  Uniprot ID: O00144
  ENST ID: ENST00000344575
  CDS Start-End: 226-2001
tggctcagcggcggctccggtggcagcggcggtggcggctaggcgggctcggcggctcctgtccctcgggcggctgcccgctcgctgcccagggcgcccggacacacgtgggcggctcagcgatggcccgcgccccgcgacgtggcgggcaggcaccggggcgcgggaccgctgagcccgagtgagccggggccgcgctcccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggca

SEQ ID NO: 135365 - DNA, 3162 bp, Homo sapiens
  Payload ID: 6463
  Gene Symbol: FRZB
  Gene Name: frizzled-related protein
  Uniprot ID: Q92765
  ENST ID: ENST00000295113
  CDS Start-End: 611-1588
acagacgtccctgcggggctcctcctgagcgtccctcctgccagccagggtcgcagccgcagcggcggccgcagctcttagcccacacaggacttgtaaactcttactgcacccttctctcccattaggagcttttcctccctccttccccccaacccctctgtcctcctcactttggggaatttaatgctttctttagcatctttttgtgtgcgtgatctaggggaggagacaccccagagctccaactagctctcagctgaattctacttttgtttttatgtcttcctcgcctcctctcgtgtccctcttatctgactgatctgcgaagtctgatgcttctgccagagggagaggaataaatagatgttgctgcttccgaaggcttagacgttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtctttttttttctcttcttttaaaataaatcagaattgccgtattgaccaggaaaagattatgtatgcacgtgcaccagggttagtttttaaaagtacatggctccataaaaatgctgtagattacagagtgataaaatatgcaggtttttttgtttttgttttttctgttgtgtgtgtgtctgtatttgtgtacatgtgtgtccttgcactcacacccaaggtggattaaaatacaggcctgcaaactggcctgcactttatcatttggatttgtgctgcttaatgctcagcgaaaaatgtctagtaaaatgaattatggttgtcaggagagaggttatttcgacttttgaaccaattgcacatttctcattacccaagctgtggtgagatcccaggggctgtggtgaacaaatgatgcttttatagatggtccctagcttacaatgattcaatttacaatgcttcaatttaacaatttgttgacttacaatgggtttatcaggatgtaacccaatgcatttcaacttacgatattttcagtttcgaatgggtttatccagatgtaaccccatcgtaaatggcggagcatctgtacttccttcctctggcagagttccttagagcctgtgccaattacttgaaagtttcattctctgccatttacatgtgtgctattagtagaaccaaatttctaagctgtggcgtgctgaaaataaaatgcttatgaagcaaaaa

SEQ ID NO: 135366 - DNA, 1434 bp, Homo sapiens
  Payload ID: 6464
  Gene Symbol: FN3K
  Gene Name: fructosamine 3 kinase
  Uniprot ID: Q9H479
  ENST ID: ENST00000300784
  CDS Start-End: 63-992
gccccgcagcgcctcagccgacaggggcttccgagcgagcagagtcccgcgccccgcactccatggagcagctgctgcgcgccgagctgcgcaccgcgaccctgcgggccttcggcggccccggcgccggctgcatcagcgagggccgagcctacgacacggacgcaggcccagtgttcgtcaaagtcaaccgcaggacgcaggcccggcagatgtttgagggggaggtggccagcctggaggccctcaggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttccttgggcaccatgcgaaggctgctcaagtagcggcccctgccctcccttcccctgtccccgtccccgtctccgtctccccgtccctgtccccccgtcccccgtccctgtgcccccgtccctgtccccctgttcccgtctccccgtccctccgtctccatccccccgtccccccatcctcctgtccccgtccccccgtccccgtccctccatccctgtcccccgtccccctgtccccctgtccacataccaatccccctgtccccgaccccccatccccgtcccccatctccgtccccgtcccccctgccccgtccccgtctccgttcccccgtccccatcctccatccccgtctcccatcgccgtccccccgtccccgtcccccgtccccgtcccccctgtccctgtcccccttcccccgacccctcccagatcctggggaccaataaagcccgcagcgggtctcggctggcg

SEQ ID NO: 135367 - DNA, 1849 bp, Homo sapiens
  Payload ID: 6465
  Gene Symbol: FN3KRP
  Gene Name: fructosamine 3 kinase related protein
  Uniprot ID: Q9HA64
  ENST ID: ENST00000269373
  CDS Start-End: 74-1003
atgtttgcccgctcggccgccgtctctcgagtctccgccagatccggggcgggtccgcggccgcggcgggaacatggaggagctcctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgctggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccactgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccatagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataacgta

SEQ ID NO: 135368 - DNA, 887 bp, Homo sapiens
  Payload ID: 6465
  Gene Symbol: FN3KRP
  Gene Name: fructosamine 3 kinase related protein
  ENST ID: ENST00000574356
  CDS Start-End: 8-445
cgggaacatggaggagctcctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggagcataacgcgctgtcaggatcgagggaattttccggtattttaatctgctgacatttggaatccgtgtgcagcccacatggtaaatgtggggagatttgctgatgatcggaacagatcaccaggggcctgctgtaggagacggagacatgctgttagtctgttctgtgagggtccatgacggatccacccaggcggcctgtgtgggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagag

SEQ ID NO: 135369 - DNA, 515 bp, Homo sapiens
  Payload ID: 6465
  Gene Symbol: FN3KRP
  Gene Name: fructosamine 3 kinase related protein
  ENST ID: ENST00000577128
  CDS Start-End: 133-515
cgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggccccaggattcgagaagcgccttcagttgtatcagctctttcactacttgaaccactggaatca

SEQ ID NO: 135370 - DNA, 625 bp, Homo sapiens
  Payload ID: 6465
  Gene Symbol: FN3KRP
  Gene Name: fructosamine 3 kinase related protein
  ENST ID: ENST00000571594
  CDS Start-End: 1-153
tttggatcggggtacagaggatcctccctgaacatcatgaggaatctggtcaaggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtccatcccgacggcgcgtgtgccgcttggctcaaggccctgacatcgttccactcagcacagcatcaggtgcccgggacccgggacatcatcgttctgtgtcagcacatcaggtgcccggggcccggacatcatcgttccactcagcacagcatcaggtgcctgggaccctggacatcattgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaccatcaggaggggtgtctcgggggtgtcgaa

SEQ ID NO: 135371 - DNA, 627 bp, Homo sapiens
  Payload ID: 6465
  Gene Symbol: FN3KRP
  Gene Name: fructosamine 3 kinase related protein
  ENST ID: ENST00000573158
  CDS Start-End: 254-627
gcagctctgtcagggccacgggccactcggggggcgggtgcatcagccagggccggagctacgacacggatcaaggacgagtgttcgtgaaagtgaaccccaaggcggagggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccct

SEQ ID NO: 135372 - DNA, 683 bp, Homo sapiens
  Payload ID: 6465
  Gene Symbol: FN3KRP
  Gene Name: fructosamine 3 kinase related protein
  ENST ID: ENST00000574206
  CDS Start-End: 1-308
aggagctcctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagttgctgtcgtttgatttgacagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaa

SEQ ID NO: 135373 - DNA, 1422 bp, Homo sapiens
  Payload ID: 6465
  Gene Symbol: FN3KRP
  Gene Name: fructosamine 3 kinase related protein
  ENST ID: ENST00000574832
  CDS Start-End: 35-205
agatccggggcgggtccgcggccgcggcgggaacatggaggagctcctgaggcgcgagctgggctgcagctctgtcagggccacgggccactcggggggcgggtgcatcagccagggccggagctacgacacggatcaaggacgagtgttcgtgaaagtgaaccccaaggcggaggtgaaaagtgaccccaggtcactggcataggcagccagggtgccgcctgcacctgagaggtcgggtgagtctgtgtcctgtaggtggaacaggactgcagttgaggtgtcgtctgaggacactgacaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgctggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgca

SEQ ID NO: 135374 - DNA, 1462 bp, Homo sapiens
  Payload ID: 6466
  Gene Symbol: FBP1
  Gene Name: fructose-1,6-bisphosphatase 1
  Uniprot ID: P09467
  ENST ID: ENST00000375326
  CDS Start-End: 198-1214
gcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaa

SEQ ID NO: 135375 - DNA, 1487 bp, Homo sapiens
  Payload ID: 6466
  Gene Symbol: FBP1
  Gene Name: fructose-1,6-bisphosphatase 1
  Uniprot ID: P09467
  ENST ID: ENST00000415431
  CDS Start-End: 231-1247
attgtggctaccagggggtcaggatgcgggcggtggagccctctggcctttgtgtggtagccgaggactctgtgtcagcgaccgttttccgggaaacttccgggcgagactcacatcttggaaattcaaatactcaatagctctcgaattctaggaatcttgagaagaggcctggattaaggattcagacgtgggccctcagatggccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctcctt

SEQ ID NO: 135376 - DNA, 629 bp, Homo sapiens
  Payload ID: 6466
  Gene Symbol: FBP1
  Gene Name: fructose-1,6-bisphosphatase 1
  ENST ID: ENST00000414122
  CDS Start-End: 177-629
acatcttggaaattcaaatactcaatagctctcgaattctaggaatcttgagaagaggcctggattaaggattcagacgtgggccctcagatggctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccagggactttgaccctgccgtcactgagtacatccagaggaagaagttcccccca

SEQ ID NO: 135377 - DNA, 1305 bp, Homo sapiens
  Payload ID: 6467
  Gene Symbol: FBP2
  Gene Name: fructose-1,6-bisphosphatase 2
  Uniprot ID: O00757
  ENST ID: ENST00000375337
  CDS Start-End: 68-1087
gctgcagccctcagaagtaagcaaggtttcctgccgggagaaaaggatttgaagcattccagccaaaatgacggacagaagccccttcgaaaccgacatgctcaccctgacccgctacgttatggaaaaggggcgtcaggccaaagggactggggagctcacccagctgctgaactcaatgctgacggccatcaaagccatctcctcggctgtgcgcaaggccggtctggcccacctgtatggaatcgcaggaagcgttaacgtgacgggagatgaggtgaagaaactggatgtgctatccaattccctggtgatcaacatggtccaatcctcctatagtacctgcgtcctggtctcagaagagaataaggacgccatcatcaccgccaaggagaagcgggggaaatacgtggtctgctttgacccactggatggatcttccaatattgactgcctggcctccatcggaaccatctttgccatctatagaaagacctcagaggatgagccttctgaaaaggatgccctgcagtgtggccgcaatattgtggccgcaggttatgcgctgtacggtagtgcaaccctggtggctctctccacagggcaaggcgtggacctcttcatgcttgacccggctcttggtgaatttgtcctggtggaaaaagatgtcaagattaagaagaaaggaaagatttacagcctgaatgagggctatgccaagtattttgatgcggccaccactgaatatgtgcagaaaaagaaattccctgaggatggcagtgctccctatggggccaggtatgtgggctccatggtggctgacgtgcaccgcaccctggtctatggaggaatcttcctgtacccagccaaccagaagagccctaagggcaagctccggctcctgtatgaatgcaatcccgtggcctacatcattgagcaggcaggaggcttggcgaccacggggacccagcctgtactggacgtgaagcccgaggcaattcaccagcgagtccccctcattctggggtcaccagaggatgtgcaggaatatctcacctgtgtgcagaaaaatcaggcaggcagctagcgagtttgaccccacatgccctcttctgtttgtcttgcaccttgtctaaggaccctaaatgaacgataaacagagatggtagctatgagtatacaaaaggtaaatccacttaatcacatacagaagagcaacaacaaactgcttacgacaggtttggaagccacaggcgattctatggtcaatgtgaaggactagaaataaaaacccacatgtggaaa

SEQ ID NO: 135378 - DNA, 11706 bp, Homo sapiens
  Payload ID: 6468
  Gene Symbol: FRYL
  Gene Name: FRY-like
  Uniprot ID: O94915
  ENST ID: ENST00000358350
  CDS Start-End: 606-9647
gaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgagctgaagccatttattggtatcttggatggttaacatctaaatgcttaattcctgaaaccactcaagagtcataggattagatgatccaagtcaccaagaaattactgtctcaagtgatacgcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaacaaatggaaatactagcagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagc

SEQ ID NO: 135379 - DNA, 5277 bp, Homo sapiens
  Payload ID: 6468
  Gene Symbol: FRYL
  Gene Name: FRY-like
  ENST ID: ENST00000507711
  CDS Start-End: 555-5216
agagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgagctgaagccatttattggtatcttggatggttaacatctaaatgcttaattcctgaaaccactcaagagtcataggattagatgatccaagtcaccaagaaattactgtctcaagtgatacgcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtaataaattccaaatgtttttaatataactataagggtgaggtgtattgttaattacattaatgttaataaatatatattttcagtaaa

SEQ ID NO: 135380 - DNA, 7033 bp, Homo sapiens
  Payload ID: 6468
  Gene Symbol: FRYL
  Gene Name: FRY-like
  Uniprot ID: O94915
  ENST ID: ENST00000507873
  CDS Start-End: 3941-5152
ccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaa

SEQ ID NO: 135381 - DNA, 618 bp, Homo sapiens
  Payload ID: 6468
  Gene Symbol: FRYL
  Gene Name: FRY-like
  ENST ID: ENST00000505759
  CDS Start-End: 47-618
acctttctgtgtgcttgtgggcctagtaatgtagaagaaccttaaaatggattttttaaagagagttgttcctcccattctttcgggagatgtggttttggatactagtactgaggaaagttccccaagattagttaagatgaaacgtcttagctcactttcatctgagaagacggtggatgagcaaggtggaaccaatttctgtcatagtaattatgacaaatacgaacaccaacaactagcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtc

SEQ ID NO: 135382 - DNA, 4364 bp, Homo sapiens
  Payload ID: 6468
  Gene Symbol: FRYL
  Gene Name: FRY-like
  ENST ID: ENST00000514617
  CDS Start-End: 1-4364
tggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattc

SEQ ID NO: 135383 - DNA, 1940 bp, Homo sapiens
  Payload ID: 6468
  Gene Symbol: FRYL
  Gene Name: FRY-like
  ENST ID: ENST00000506685
  CDS Start-End: 155-1570
ctttccctttaaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcaggtaactatagtgacttcattctacccaatcttgttttgagacttatgacagacacatatgtatacatgtacatgtgcatacataaaataacttccttaacaaatgtaatgagttagaaagtatttttgaaaagtagaaaatgcttaagagtagtacttaaaaagtgacattcatttatacttggttaagtactcttctacatagaaataaaaattattttatgtttgtaaaattctcatccttccaatctaagaagtttctgttaaatggaatctttatgctaccgtttgctctttattatggcatataatattcgtgagatagaaatacttgtgaaaatgctacgggaaaaaaatggtgatactcaaagcaaaaacttacaccctgcttttttggcaactgttttttg

SEQ ID NO: 135384 - DNA, 11103 bp, Homo sapiens
  Payload ID: 6468
  Gene Symbol: FRYL
  Gene Name: FRY-like
  Uniprot ID: O94915
  ENST ID: ENST00000503238
  CDS Start-End: 1-9042
atgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaacaaatggaaatactagcagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagcaa

SEQ ID NO: 135385 - DNA, 1074 bp, Homo sapiens
  Payload ID: 6469
  Gene Symbol: FRG1
  Gene Name: FSHD region gene 1
  Uniprot ID: Q14331
  ENST ID: ENST00000226798
  CDS Start-End: 223-999
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacaga

SEQ ID NO: 135386 - DNA, 755 bp, Homo sapiens
  Payload ID: 6469
  Gene Symbol: FRG1
  Gene Name: FSHD region gene 1
  ENST ID: ENST00000524583
  CDS Start-End: 448-755
gcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggcgagatagaaagtatcaaggagtgagttgaagccactggccttgagaaccctctcgaggagtctggcctcatgaagatgccagaataaatggcagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaaggggaaaatggctttgttggcctcaaatagctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattct

SEQ ID NO: 135387 - DNA, 738 bp, Homo sapiens
  Payload ID: 6469
  Gene Symbol: FRG1
  Gene Name: FSHD region gene 1
  ENST ID: ENST00000531991
  CDS Start-End: 391-738
agtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggcgagatagaaagtatcaaggagtgagttgaagccactggccttgagaaccctctcgaggagtctggcctcatgaagatgccagaataaatgtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaag

SEQ ID NO: 135388 - DNA, 714 bp, Homo sapiens
  Payload ID: 6469
  Gene Symbol: FRG1
  Gene Name: FSHD region gene 1
  ENST ID: ENST00000533157
  CDS Start-End: 112-240
ggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaa

SEQ ID NO: 135389 - DNA, 421 bp, Homo sapiens
  Payload ID: 6469
  Gene Symbol: FRG1
  Gene Name: FSHD region gene 1
  ENST ID: ENST00000507103
  CDS Start-End: 1-255
attagatcctgtgctgaaagagaaaccaagaaaaaagatgacattccagaagaagacaaaggaaatgtaaaacaatgtgaaatcaattatgtatggagtctcgctctctcccccagactagagtgccatggcgcgatctcggctcatcgcaacctccgcttcccaggttcatgtgattctcctgcctcagcctcccgagtagctgggactacagaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagag

SEQ ID NO: 135390 - DNA, 1074 bp, Homo sapiens; identical to SEQ ID NO: 135385
  Payload ID: 6469
  Gene Symbol: FRG1
  Gene Name: FSHD region gene 1
  Uniprot ID: Q14331
  ENST ID: ENST00000620886
  CDS Start-End: 223-999

SEQ ID NO: 135391 - DNA, 755 bp, Homo sapiens; identical to SEQ ID NO: 135386
  Payload ID: 6469
  Gene Symbol: FRG1
  Gene Name: FSHD region gene 1
  ENST ID: ENST00000624356
  CDS Start-End: 448-755

SEQ ID NO: 135392 - DNA, 714 bp, Homo sapiens; identical to SEQ ID NO: 135388
  Payload ID: 6469
  Gene Symbol: FRG1
  Gene Name: FSHD region gene 1
  ENST ID: ENST00000625559
  CDS Start-End: 112-240

SEQ ID NO: 135393 - DNA, 738 bp, Homo sapiens; identical to SEQ ID NO: 135387
  Payload ID: 6469
  Gene Symbol: FRG1
  Gene Name: FSHD region gene 1
  ENST ID: ENST00000627466
  CDS Start-End: 391-738

SEQ ID NO: 135394 - DNA, 421 bp, Homo sapiens; identical to SEQ ID NO: 135389
  Payload ID: 6469
  Gene Symbol: FRG1
  Gene Name: FSHD region gene 1
  ENST ID: ENST00000627980
  CDS Start-End: 1-255

SEQ ID NO: 135395 - DNA, 2084 bp, Homo sapiens
  Payload ID: 6470
  Gene Symbol: FRG2
  Gene Name: FSHD region gene 2
  Uniprot ID: Q64ET8
  ENST ID: ENST00000378763
  CDS Start-End: 54-890
cacactctgcctttggacgtgagagagagcgcacctttcacttgagcttcaacatgggaaagggaaatgaagactccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactgctgtgcacaacagtgaaatccaggagacctgtgatgcccaccataggggacattccagggcttgcactgggcacagcaagcggcataggtctcgggccctaggagtccaaacaccgtcaattcgaaaaagcttggtgacttctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatatttttagtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaa

SEQ ID NO: 135396 - DNA, 2100 bp, Homo sapiens
  Payload ID: 6470
  Gene Symbol: FRG2
  Gene Name: FSHD region gene 2
  Uniprot ID: Q64ET8
  ENST ID: ENST00000504750
  CDS Start-End: 51-890
actctgcctttggacgtgagagagagcgcacctttcacttgagcttcaacatgggaaagggaaatgaagactccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaagcaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactgctgtgcacaacagtgaaatccaggagacctgtgatgcccaccataggggacattccagggcttgcactgggcacagcaagcggcataggtctcgggccctaggagtccaaacaccgtcaattcgaaaaagcttggtgacttctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatatttttagtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaaaatgtgaaaaagagaa

SEQ ID NO: 135397 - DNA, 2084 bp, Homo sapiens; identical to SEQ ID NO: 135395
  Payload ID: 6470
  Gene Symbol: FRG2
  Gene Name: FSHD region gene 2
  Uniprot ID: Q64ET8
  ENST ID: ENST00000611713
  CDS Start-End: 54-890

SEQ ID NO: 135398 - DNA, 2100 bp, Homo sapiens; identical to SEQ ID NO: 135396
  Payload ID: 6470
  Gene Symbol: FRG2
  Gene Name: FSHD region gene 2
  Uniprot ID: Q64ET8
  ENST ID: ENST00000629452
  CDS Start-End: 51-890

SEQ ID NO: 135399 - DNA, 890 bp, Homo sapiens
  Payload ID: 6471
  Gene Symbol: FRG2B
  Gene Name: FSHD region gene 2 family, member B
  Uniprot ID: Q96QU4
  ENST ID: ENST00000425520
  CDS Start-End: 54-890
cacactctgcctttggacgtgagagagagcgcacctttcacttgagcttcaacatgggaaagggaaatgaagaccccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactcctgtgcacaacagtgaaatccaggagacctgtgatgcccaccataggggacgttccagggcttgcactgggcgcagcaagcggcataggtctcgggccctaggagtccaaacaccgtcaattcgaaaaagcttggtgacctctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtga

SEQ ID NO: 135400 - DNA, 2094 bp, Homo sapiens
  Payload ID: 6471
  Gene Symbol: FRG2B
  Gene Name: FSHD region gene 2 family, member B
  ENST ID: ENST00000443774
  CDS Start-End: 51-890
actctgcctttggacgtgagagagagcgcacctttcacttgagcttcaacatgggaaagggaaatgaagaccccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaagcaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactcctgtgcacaacagtgaaatccaggagacctgtgatgcccaccataggggacgttccagggcttgcactgggcgcagcaagcggcataggtctcgggccctaggagtccaaacaccgtcaattcgaaaaagcttggtgacctctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatattttgtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaaaatgtgaaaaagagaa

SEQ ID NO: 135401 - DNA, 2078 bp, Homo sapiens
  Payload ID: 6472
  Gene Symbol: FRG2C
  Gene Name: FSHD region gene 2 family, member C
  Uniprot ID: A6NGY1
  ENST ID: ENST00000308062
  CDS Start-End: 51-899
actctgcctttggacatgtgagagagcgcacctttcacttgagcttcaacatgggaaagggaaatgaagaccccgatctccactgttcctccatccagtgctccactgaccagccccctttccaacagatctcctttacagaaaagggctcagatgagaagaaaccattcaaaggaaaaggcaagaccgccttctcccattccagtgagaagcacacacaaaggcaagcaggatcagatcccaatccaaacaaggagaattctgaggaaaccaagctcaaggccgggaacagcactgctggatcagaaccagagtccagctcatatcaggaaaactgcaggaaaagaaaaatcagttccaaggatatctgccaagacagagcagggaactgtccagaagaggagtgcaacttgacgttgaataaaaaatcaagatcctccactgctgtgcacaacagtgaaatccaggagacctgtgatgcccaccataggggaagttccagggcttgcactgggcgcagcaagcggcataggtctcgggccctagaagtccaaacaccgtcacttcgaaaaagcttggtgacctctgtgcgagctatgtcggaggctgtttatcaagacctagcccaggtgtgggcacagcagatccattctccactgacctgtgagcagctgacactgctcactcggctccgggggcctctgtgtgcccaggtgcagaccttgtattccatggccactcaggcagcttatgtcttccctgctgagagctggcttgtcccagccacactgcctggtcctggggattcagccctggatagagaagcccatcccttccctgggcaggagataactgagcctgtcagtggatcagatgaggctaagctgggagcaccctgaccctattcagcagagatgcagctctgggaatgagaacaaggacctgcttcttctcagattcttccagacgaccagcagtgacaattttagatgcactgtgttaataaatgacagaacctgaagaagtcataggaaagaaacttgagcggtatactcagaatggtgagccctgaattttgcagaccgctaaggctatagacaaattttatatttcatgttagacatttgataccttttggatgtctgatgacagtcgtgcatttctatataatcagaaaaatattaggttgcaatcgtgaattttcatattttagattgtagaaaagtaaatataaaattatatgctctttttttttttgagacagtcttgctatgtcactcaggctggagtgcagtggcacaatcttagctcactgcaacctctgcttcctgggttcaaacaattctcatgcctcagcctcccaagtagctgggactacaggcatgtaccgccatgcctggctaatgtttttttcttgtattgttagtagagttttgtcacgttggccaggttggcctcggactcaagtgatccaccagcctccacctcccgacgtggtggggttacaggcatgagccgctttaccaagaaattgcttctcttttaattcggaaaaggttgtaggctcttccagcctgaacccatggagtactaacatccacaaaccattaatagcactccctgtgggaaaatgtttatacatttttacagtttgcatagtaaaattactatgcaagctgtttacttttaatatttctacataaaatttaagtcaagatatattaaatggtaaatgattgtacttatttattcatctgcctcatgttttatttcattttaaacatcctgaatttatattttattgtatttcatacatttcaattgattgtactgtattgcaggatatggagatttcatcacatactacaatacagtgtattttgttatatttgacgtatattctacttgtattttgtactgagatcatacaatctttcattatctaagtgtattaatgacttgtttggttgctttataattttcattttatgtaataatgaaataaacattaatgttgtttggaattttaaatttctttcatatggaatttgtatttaataaagatgtgaaaaagagaa

SEQ ID NO: 135402 - DNA, 2075 bp, Homo sapiens
  Payload ID: 6472
  Gene Symbol: FRG2C
  Gene Name: FSHD region gene 2 family, member C
  ENST ID: ENST00000464571
  CDS Start-End: 51-896
actctgcctttggacatgtgagagagcgcacctttcacttgagcttcaacatgggaaagggaaatgaagaccccgatctccactgttcctccatccagtgctccactgaccagccccctttccaacagatctcctttacagaaaagggctcagatgagaagaaaccattcaaaggaaaaggcaagaccgccttctcccattccagtgagaagcacacacaaaggcaaggatcagatcccaatccaaacaaggagaattctgaggaaaccaagctcaaggccgggaacagcactgctggatcagaaccagagtccagctcatatcaggaaaactgcaggaaaagaaaaatcagttccaaggatatctgccaagacagagcagggaactgtccagaagaggagtgcaacttgacgttgaataaaaaatcaagatcctccactgctgtgcacaacagtgaaatccaggagacctgtgatgcccaccataggggaagttccagggcttgcactgggcgcagcaagcggcataggtctcgggccctagaagtccaaacaccgtcacttcgaaaaagcttggtgacctctgtgcgagctatgtcggaggctgtttatcaagacctagcccaggtgtgggcacagcagatccattctccactgacctgtgagcagctgacactgctcactcggctccgggggcctctgtgtgcccaggtgcagaccttgtattccatggccactcaggcagcttatgtcttccctgctgagagctggcttgtcccagccacactgcctggtcctggggattcagccctggatagagaagcccatcccttccctgggcaggagataactgagcctgtcagtggatcagatgaggctaagctgggagcaccctgaccctattcagcagagatgcagctctgggaatgagaacaaggacctgcttcttctcagattcttccagacgaccagcagtgacaattttagatgcactgtgttaataaatgacagaacctgaagaagtcataggaaagaaacttgagcggtatactcagaatggtgagccctgaattttgcagaccgctaaggctatagacaaattttatatttcatgttagacatttgataccttttggatgtctgatgacagtcgtgcatttctatataatcagaaaaatattaggttgcaatcgtgaattttcatattttagattgtagaaaagtaaatataaaattatatgctctttttttttttgagacagtcttgctatgtcactcaggctggagtgcagtggcacaatcttagctcactgcaacctctgcttcctgggttcaaacaattctcatgcctcagcctcccaagtagctgggactacaggcatgtaccgccatgcctggctaatgtttttttcttgtattgttagtagagttttgtcacgttggccaggttggcctcggactcaagtgatccaccagcctccacctcccgacgtggtggggttacaggcatgagccgctttaccaagaaattgcttctcttttaattcggaaaaggttgtaggctcttccagcctgaacccatggagtactaacatccacaaaccattaatagcactccctgtgggaaaatgtttatacatttttacagtttgcatagtaaaattactatgcaagctgtttacttttaatatttctacataaaatttaagtcaagatatattaaatggtaaatgattgtacttatttattcatctgcctcatgttttatttcattttaaacatcctgaatttatattttattgtatttcatacatttcaattgattgtactgtattgcaggatatggagatttcatcacatactacaatacagtgtattttgttatatttgacgtatattctacttgtattttgtactgagatcatacaatctttcattatctaagtgtattaatgacttgtttggttgctttataattttcattttatgtaataatgaaataaacattaatgttgtttggaattttaaatttctttcatatggaatttgtatttaataaagatgtgaaaaagagaa

SEQ ID NO: 135403 - DNA, 3559 bp, Homo sapiens
  Payload ID: 6473
  Gene Symbol: FTSJ3
  Gene Name: FtsJ homolog 3 (E. coli)
  Uniprot ID: Q8IY81
  ENST ID: ENST00000427159
  CDS Start-End: 647-3190
gacacagcagatccggtcgcaggcagcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgcggaagcggaggattgggacctgaagaccaggcagagaagaattccgggtcaatgggcggggtgtgcggcgagaccacactaagggaaccatgatgggaggggcggctactcgagttcaggggctttggaaggggatgaggaaggagtagaactcctcctcagtgttgcctcattgaaactctgtttatagttcttgtgatatgccttcctagtctcaactttcaacttacaaaacccaaggacagagtattgagaacaatctagggccacactcaaaatggcggaaaacctcgagccagggacgcaggggacgcaagcggaagcggaagtagttagctgcatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgagcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctgaataaaaccaggataatggaa

SEQ ID NO: 135404 - DNA, 411 bp, Homo sapiens
  Payload ID: 6473
  Gene Symbol: FTSJ3
  Gene Name: FtsJ homolog 3 (E. coli)
  ENST ID: ENST00000579831
  CDS Start-End: 1-90
gatctgcctggggtttccattgcagacgagggggagactggcatgttctccttgagcaccatccggggtcaccagtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgc

SEQ ID NO: 135405 - DNA, 615 bp, Homo sapiens
  Payload ID: 6473
  Gene Symbol: FTSJ3
  Gene Name: FtsJ homolog 3 (E. coli)
  ENST ID: ENST00000580272
  CDS Start-End: 163-615
gctctgggtctaggtagtgtgcggagaggggcgcggggtggaattgctgcgggaagtgggaaactggaagtgggaaactggaagtggaatctggtgctccggaaagagacgttcccaacttctactttctccccagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggt

SEQ ID NO: 135406 - DNA, 522 bp, Homo sapiens
  Payload ID: 6473
  Gene Symbol: FTSJ3
  Gene Name: FtsJ homolog 3 (E. coli)
  ENST ID: ENST00000579569
  CDS Start-End: 9-212
tttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggttcgtaacactcgccacaggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatca

SEQ ID NO: 135407 - DNA, 535 bp, Homo sapiens
  Payload ID: 6473
  Gene Symbol: FTSJ3
  Gene Name: FtsJ homolog 3 (E. coli)
  ENST ID: ENST00000585145
  CDS Start-End: 478-535
agcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgcggaagcggaggattgggacctgaagaccaggcagagaagaattccgggtcaatgggcggggtgtgcgtctcaactttcaacttacaaaacccaaggacagagtattgagaacaatctagggccacactcaaaatggcggaaaacctcgagccagggacgcaggggacgcaagcggaagcggaagtagttagctgcatacttgtgcggttccaagtgtggagaaagcggctctgggtctagattgagggatactccccctttccaccatgggcaagaagggcaaagttggcaagagccgacgagacaagttttatcacttggcga

SEQ ID NO: 135408 - DNA, 548 bp, Homo sapiens
  Payload ID: 6473
  Gene Symbol: FTSJ3
  Gene Name: FtsJ homolog 3 (E. coli)
  ENST ID: ENST00000584193
  CDS Start-End: 29-151
agattgagggatactccccctttccaccatgggcaagaagggcaaagttggcaagagccgacgagacaagttttatcacttggcgaaggagacggtttgcgcacttggttgttttgtccaggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatca

SEQ ID NO: 135409 - DNA, 543 bp, Homo sapiens
  Payload ID: 6473
  Gene Symbol: FTSJ3
  Gene Name: FtsJ homolog 3 (E. coli)
  ENST ID: ENST00000584574
  CDS Start-End: 443-543
agcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgcggaagcggaggattgggacctgaagaccaggcagagaagaattccgggtcaatgggcggggtgtgcgttcttgtgatatgccttcctagtctcaactttcaacttacaaaacccaaggacagagtattgagaacaatctagggccacactcaaaatggcggaaaacctcgagccagggacgcaggggacgcaagcggaagcggaaattgagggatactccccctttccaccatgggcaagaagggcaaagttggcaagagccgacgagacaagttttatcacttggcgaaggagacgggttaccgttcccgatctgctttcaagctgatcca

SEQ ID NO: 135410 - DNA, 592 bp, Homo sapiens
  Payload ID: 6473
  Gene Symbol: FTSJ3
  Gene Name: FtsJ homolog 3 (E. coli)
  ENST ID: ENST00000581209
  CDS Start-End: 248-592
actcgagttcaggggctttggaaggggatgaggaaggagtagaactcctcctcagtgttgcctcattgaaactctgtttatagttcttgtgatatgccttcctagtctcaactttcaacttacaaaacccaaggacagagtattgagaacaatctagggccacactcaaaatggcggaaaacctcgagccagggacgcaggggacgcaagcggaagcggaaattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctc

SEQ ID NO: 135411 - DNA, 1986 bp, Homo sapiens
  Payload ID: 6474
  Gene Symbol: FTSJ1
  Gene Name: FtsJ RNA methyltransferase homolog 1 (E. coli)
  Uniprot ID: Q9UET6
  ENST ID: ENST00000019019
  CDS Start-End: 430-1413
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaaggggaccagtagacggggtggattcgaggtggggacatgggacgcagcggtcggagccgcctggaggggtacccggtggtcccgatggagctatcatctttgagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgca

SEQ ID NO: 135412 - DNA, 1892 bp, Homo sapiens
  Payload ID: 6474
  Gene Symbol: FTSJ1
  Gene Name: FtsJ RNA methyltransferase homolog 1 (E. coli)
  Uniprot ID: Q9UET6
  ENST ID: ENST00000348411
  CDS Start-End: 324-1313
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaa

SEQ ID NO: 135413 - DNA, 1669 bp, Homo sapiens
  Payload ID: 6474
  Gene Symbol: FTSJ1
  Gene Name: FtsJ RNA methyltransferase homolog 1 (E. coli)
  ENST ID: ENST00000396894
  CDS Start-End: 453-1031
aaatcgatcttggcctcggaagaaaaagaacaaagaatcgctggcaacttgcgcgtcgcgtcgctgcagccacgcagtgcgtggattcagccgctttggccgtgcccgttgcatgccgggaaacgcagttcgcgagccccggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagctgtccactgccaaggagatcatccagcactttaagggctgccctgcggacctagtggtgtgtgacggggctcctgatggctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgacccagatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 135414 - DNA, 1601 bp, Homo sapiens
  Payload ID: 6475
  Gene Symbol: FTSJ2
  Gene Name: FtsJ RNA methyltransferase homolog 2 (E. coli)
  Uniprot ID: Q9UI43
  ENST ID: ENST00000242257
  CDS Start-End: 30-770
gcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaa

SEQ ID NO: 135415 - DNA, 582 bp, Homo sapiens
  Payload ID: 6475
  Gene Symbol: FTSJ2
  Gene Name: FtsJ RNA methyltransferase homolog 2 (E. coli)
  ENST ID: ENST00000407040
  CDS Start-End: 49-507
aatgaaagacaaggtagaaaggtgcagtgaacatggaaatcacctcgcatgagaccgcccgcagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagt

SEQ ID NO: 135416 - DNA, 1570 bp, Homo sapiens
  Payload ID: 6475
  Gene Symbol: FTSJ2
  Gene Name: FtsJ RNA methyltransferase homolog 2 (E. coli)
  Uniprot ID: Q9UI43
  ENST ID: ENST00000440306
  CDS Start-End: 1-741
atggccgggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagc

SEQ ID NO: 135417 - DNA, 4081 bp, Homo sapiens
  Payload ID: 6476
  Gene Symbol: FUK
  Gene Name: fucokinase
  Uniprot ID: Q8N0W3
  ENST ID: ENST00000288078
  CDS Start-End: 233-3487
cttctggattgcagccccgctgcccttcaggaaagcgctgccccggccacccacgctggcctatgcggtggctccgaccgtgttttttgccggacgggggctcggccttgggggggcgcggaggtgaaactacacttcccggagtgcaccgcgagggtcgcgcagcctcgcgttaaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 135418 - DNA, 3925 bp, Homo sapiens
  Payload ID: 6476
  Gene Symbol: FUK
  Gene Name: fucokinase
  Uniprot ID: Q8N0W3
  ENST ID: ENST00000378912
  CDS Start-End: 59-3331
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcacttggatttgtgttggagtctctctctggattcgagggtgccatcctccagggcgtctgcctgaggcctctgttcacagggctttcccactcctgcaggtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 135419 - DNA, 538 bp, Homo sapiens
  Payload ID: 6476
  Gene Symbol: FUK
  Gene Name: fucokinase
  ENST ID: ENST00000572784
  CDS Start-End: 179-538
aaagagcccgctccgccgagcgccgggcgacggcagggtcttgctgtgtcagccaggctggagtgcagtggagtgatcatggctcactgcagccttaacctcctgggctcaagcagtcctcccaccttggtcttccaaagtgctgggattatagacgaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtg

SEQ ID NO: 135420 - DNA, 539 bp, Homo sapiens
  Payload ID: 6476
  Gene Symbol: FUK
  Gene Name: fucokinase
  ENST ID: ENST00000576453
  CDS Start-End: 102-539
accgagtcgacccgcgggccgcccgggtcctgacagggaagagtccccgggagctctgcggtgccccgggagcccacaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtg

SEQ ID NO: 135421 - DNA, 590 bp, Homo sapiens
  Payload ID: 6476
  Gene Symbol: FUK
  Gene Name: fucokinase
  ENST ID: ENST00000574784
  CDS Start-End: 122-590
aaagagcccgctccgccgagcgccgggcgacggcagtgcctttgcttgggaccagatatcattatcactatcacctgaataaggatccaaaagacccaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctg

SEQ ID NO: 135422 - DNA, 564 bp, Homo sapiens
  Payload ID: 6476
  Gene Symbol: FUK
  Gene Name: fucokinase
  ENST ID: ENST00000573352
  CDS Start-End: 237-564
accgagtcgacccgcgggccgcccgggtcctgacagggaagagtccccgggagctctgcggtgccccgggagcccacaggtgtttctacgctcccgcgtccatttggcctgggtcttccaaggggagccccgcgacccggctggtgcggccggacctgctggcagctgggaccgggagggatgcgggcctcagaggatcctcaccctgaggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacct

SEQ ID NO: 135423 - DNA, 3054 bp, Homo sapiens
  Payload ID: 6476
  Gene Symbol: FUK
  Gene Name: fucokinase
  ENST ID: ENST00000571514
  CDS Start-End: 734-2461
aaagagcccgctccgccgagcgccgggcgacggcaggtctctggggttgtcttcttctctgtggagactgccgagcgcctcctagccacccacgtgagcccgcccctggatgcctgcacctacctaggcttggactccggagcccggcctgtccagcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcaggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagccctgactgcttcttcctctcccccagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgc

SEQ ID NO: 135424 - DNA, 1319 bp, Homo sapiens
  Payload ID: 6476
  Gene Symbol: FUK
  Gene Name: fucokinase
  ENST ID: ENST00000498702
  CDS Start-End: 1-612
gagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactgtagagacggggtttcaccgtgttagccaggatggtctcgatctcctgacctcgtgatccgcccgcctcggcctcccaaagtgctgggattacaggcgtgagccaccgcgcccggcctgtgctgtgcctctcatgcttgttggaaccaggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaa

SEQ ID NO: 135425 - DNA, 709 bp, Homo sapiens
  Payload ID: 6477
  Gene Symbol: FUOM
  Gene Name: fucose mutarotase
  Uniprot ID: A2VDF0
  ENST ID: ENST00000278025
  CDS Start-End: 29-493
aggccccgcccgccccgtctgccgggccatggtggcgctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaagagtccaattcc

SEQ ID NO: 135426 - DNA, 628 bp, Homo sapiens
  Payload ID: 6477
  Gene Symbol: FUOM
  Gene Name: fucose mutarotase
  ENST ID: ENST00000368551
  CDS Start-End: 132-461
ctgggcggagccggcccgagcttctcccggagtccctccccagacggcccgagagccctcgcgtctgggctgcccccgaggttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccc

SEQ ID NO: 135427 - DNA, 762 bp, Homo sapiens
  Payload ID: 6477
  Gene Symbol: FUOM
  Gene Name: fucose mutarotase
  Uniprot ID: A2VDF0
  ENST ID: ENST00000368552
  CDS Start-End: 19-423
cgccccgtctgccgggccatggtggcgctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggatgctgaagcagggtctcggcaccctggccctgcagcccagctcagtgctgggcttggctcctctgcagggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaagagtcc

SEQ ID NO: 135428 - DNA, 590 bp, Homo sapiens
  Payload ID: 6477
  Gene Symbol: FUOM
  Gene Name: fucose mutarotase
  ENST ID: ENST00000447176
  CDS Start-End: 1-384
aagggtgtccccgcactgctgtcccccgagctgctctacgcgctggcgcggatggggcacggggacgagatcggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaaga

SEQ ID NO: 135429 - DNA, 1380 bp, Homo sapiens
  Payload ID: 6478
  Gene Symbol: FPGT
  Gene Name: fucose-1-phosphate guanylyltransferase
  Uniprot ID: O14772
  ENST ID: ENST00000370894
  CDS Start-End: 39-548
tgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctca

SEQ ID NO: 135430 - DNA, 3254 bp, Homo sapiens
  Payload ID: 6478
  Gene Symbol: FPGT
  Gene Name: fucose-1-phosphate guanylyltransferase
  ENST ID: ENST00000370898
  CDS Start-End: 29-1852
aaccgggcggaggcgcaccccagggcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttcaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcgagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagttttaccaaatctgaagtgccatcagttataagaatcaccattattttatgttccattaagaaaaacacaataaaacatgacactgctttttttgtta

SEQ ID NO: 135431 - DNA, 582 bp, Homo sapiens
  Payload ID: 6478
  Gene Symbol: FPGT
  Gene Name: fucose-1-phosphate guanylyltransferase
  ENST ID: ENST00000529485
  CDS Start-End: 36-341
gtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattgtagagacggggtttcaccatgttagccaggacggtctgtatctcctgacctcgtgatccacctgcctcggcctcccaaagtgctgggattacaggcgtgatattatttccatagatgagaatctgaggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatt

SEQ ID NO: 135432 - DNA, 1426 bp, Homo sapiens
  Payload ID: 6478
  Gene Symbol: FPGT
  Gene Name: fucose-1-phosphate guanylyltransferase
  Uniprot ID: O14772
  ENST ID: ENST00000534056
  CDS Start-End: 13-1035
gaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttgatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctattttt

SEQ ID NO: 135433 - DNA, 561 bp, Homo sapiens
  Payload ID: 6478
  Gene Symbol: FPGT
  Gene Name: fucose-1-phosphate guanylyltransferase
  ENST ID: ENST00000482102
  CDS Start-End: 38-451
gcgtgctgtgcggcgcggtctcagggaaggtggggctatggcagctgctagggaccctccggaagtatcgctgcgagaagccacccagcgaaaattgcggaggttttccgagctaagaggtaccagagaaggcaccggagttctcctgggcaatgcagagggagggtgcttttacgtgccaggaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggtacgcgctttatggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaaacta

SEQ ID NO: 135434 - DNA, 524 bp, Homo sapiens
  Payload ID: 6478
  Gene Symbol: FPGT
  Gene Name: fucose-1-phosphate guanylyltransferase
  ENST ID: ENST00000472069
  CDS Start-End: 1-524
gagctaagaggtaccagagaaggcaccggagttctcctgggcaatgcagagggagggtgcttttacgtgccaggaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggaga

SEQ ID NO: 135435 - DNA, 601 bp, Homo sapiens
  Payload ID: 6478
  Gene Symbol: FPGT
  Gene Name: fucose-1-phosphate guanylyltransferase
  ENST ID: ENST00000467578
  CDS Start-End: 3-389
gcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggtacgcgctttatggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggagaatttgagtttattagg

SEQ ID NO: 135436 - DNA, 2047 bp, Homo sapiens
  Payload ID: 6479
  Gene Symbol: FUCA1
  Gene Name: fucosidase, alpha-L- 1, tissue
  Uniprot ID: P04066
  ENST ID: ENST00000374479
  CDS Start-End: 9-1409
gggtagcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctaccaaaaaaa

SEQ ID NO: 135437 - DNA, 2356 bp, Homo sapiens
  Payload ID: 6480
  Gene Symbol: FUCA2
  Gene Name: fucosidase, alpha-L- 2, plasma
  Uniprot ID: Q9BTY2
  ENST ID: ENST00000002165
  CDS Start-End: 57-1460
cagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaatttttttttgtgccaacatcatagagtgtatttacaaaatcctagatggcatagcctactacacacctaatgtgtatggtatagactgttgctcctaggctacagacatatacagcatgttactgaatactgtaggcaatagtaacagtggtatttgtatatcgaaacatatggaaacatagagaaggtacagtaaaaatactgtaaaataaatggtgcacctgtatagggcacttaccacgaatggagcttacaggactggaagttgctctgggtgagtcagtgagtgaatgtgaaggcctaggacattattgaacactgccagactttataaatactgtatgcttaggctacactacatttataaaaaaaagtttttctttcttcaattataaattaacataagtgtactgtaactttacaaacgttttaatttttaaaacctttttggctcttttgtaataacacttagcttaaaacataaactcattgtgcaaatgtac

SEQ ID NO: 135438 - DNA, 737 bp, Homo sapiens
  Payload ID: 6480
  Gene Symbol: FUCA2
  Gene Name: fucosidase, alpha-L- 2, plasma
  ENST ID: ENST00000451668
  CDS Start-End: 1-330
caacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtaagagggaattttaccttattcctttaaattgctgattagaacatcttgatgcaaacattaacttttaaggggagccttataactgtttcacttatacttcataaaaggaattgtaaatgagctccagccaagcattgtggctcacactgtaattccagcactttgggaggctaaggcaggaggatgtcttgaggccagaagtttgagactagcctgggcaacatagcaagacccctgtctacaaaaattttttttaaagttagctgagcatggtggcacgcacctgtagtcctagttactcaggaggctgaggcaggaggattgcttgagcccagtaggtcaagactacagtaagctatgactgcaccacttcagcctgtctctgaaaaaataaaataaaatataataaaataaaatgaatttcaccaatgaca

SEQ ID NO: 135439 - DNA, 4246 bp, Homo sapiens
  Payload ID: 6481
  Gene Symbol: FUT1
  Gene Name: fucosyltransferase 1 (galactoside 2-alpha-L-fucosyltransferase, H blood group)
  Uniprot ID: P19526
  ENST ID: ENST00000310160
  CDS Start-End: 976-2073
gaaagtccctgactggagttggcagccaagccaggccctggagtgggcacccagagggaagacaggttggctaatttcctggagcccctaagggtgcaagggggaagaacacccacccgcaaagccccgtagggctggaccctacgttagcctgccctgctcggggttggcgatgctggaggtgggccttggaccagagaaaatgctttaattaggtgacaagcgggcagaggcctttgtctctggcgccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatgctgcggctgctcagaagccaggtagcctgccctgggtgaagccttcgcgcaggtcaatgacggggcggaggggcagggcgcggtcccctgcatccccgatctggggagcggtgggcccaggggccatcgccttagcccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggctgccgggccggatagccggacgcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccaggatggtctcgatctcctgaccttgtcatccacctgtcttggcctcccaaagtgctgggattactggcatgagccactgtgcccagcccggatattttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaa

SEQ ID NO: 135440 - DNA, 3825 bp, Homo sapiens
  Payload ID: 6482
  Gene Symbol: FUT10
  Gene Name: fucosyltransferase 10 (alpha (1,3) fucosyltransferase)
  Uniprot ID: Q6P4F1
  ENST ID: ENST00000327671
  CDS Start-End: 633-2072
gctccagtcctagtccagttggagaagcggagagtttcccctgtcttaaagaagagggcccccgcagccttcccgagaactttccatagggccgtggcctcaggcggactgcgaaccaagatcatcagcagggggcggcccggtgttcttagaacccgggtcccaagagcttgtgaacagggcacgagtgaaaacccggatccaggctggctccgccggaacgcgccccgagctcgcccgcgcggccgcctcttccgctcctgatcggctcttcgggtcttcccggcgcccaggcttgggctcatagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctccatcggccttagtttttgcatccaaaaagaagtgattgggctggtcttggaaggtttttttcttttttttcccctgtgtaacattcttcattgttcatcaacatttaagaaatttaattttgtagatgtttttactaaagagggtaacaaactattttggaactgctgtatgttattcaagggaagcacgctgtttggaggaaggagcatacttaatgggtagtattgaggatgaaagggaatttctctctctgccattttatttgataatattaaagaaataaagactggaaagggggattccttgttaaaggtcagattttaaattgcatataaaa

SEQ ID NO: 135441 - DNA, 2042 bp, Homo sapiens
  Payload ID: 6482
  Gene Symbol: FUT10
  Gene Name: fucosyltransferase 10 (alpha (1,3) fucosyltransferase)
  Uniprot ID: Q6P4F1
  ENST ID: ENST00000524021
  CDS Start-End: 374-1729
atagggagaaaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaat

SEQ ID NO: 135442 - DNA, 3115 bp, Homo sapiens
  Payload ID: 6482
  Gene Symbol: FUT10
  Gene Name: fucosyltransferase 10 (alpha (1,3) fucosyltransferase)
  Uniprot ID: Q6P4F1
  ENST ID: ENST00000518672
  CDS Start-End: 244-1599
agaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcagactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtgagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaacatgaaatacattagaacttggcaatgagagatcccatctgttggtttccagggatgtaagtgagtaataaaagctgtttcaagtttatccactatccactcttcaagtgaaaagaacttatgtgtgtctaccttcttctccataccctgagccacctctctcactttctttagttgtgccttgccctatcgcctcccattttcccttcaaagtagaatgtcttgtaaagacacagtaactcctgtgtgttttgattagtgagatgttaccacttaccccttctgctgcgcagaataatattaagaattgctatgcttatgattcaggctggacagcctggacattttgagcagcgcgagagtagaagtgaatacccccaggaactccaattgtgctgaagctgatttgtctgttcgtaggatgatgtgcagcctgtcacagtggcagccacaggcattcagtttgtgggcatttcctgtcatttcggatcctgctatagggaaggttcagctctcctgtctggggcatctactggagcacctcagaagacaaggaggaaaacactggctcatgttttctttccatgtgagggaggggaggtttctagatgatactaaaagcctgttgccactgttgtgtcatgatttccattcttcatcatggaaagccacaagcctcagaaggcagccagaggacaggaagagtctgtgatgctcatgtctgtgtcatggcatgagggggaattgacgagtgcttgcttagcatcagctctcattgtattgaaggctgtgcccttggtgtgcttagcagtgagcagcgtcttcattaggtagctctggctgggctttgtcagccagcgtgtgagaaaggagaaccaaaaccaatacctccttatagaagccagaaggatcacattggatgagagaaggtgtctataactgggttcttcccaatcccagctctttcattaactaaatatgatcttggacatatctcttaacctccatcggccttagtttttgcatccaaaaagaagtgattgggctggtcttggaaggtttttttcttttttttcccctgtgtaacattcttcattgttcatcaa

SEQ ID NO: 135443 - DNA, 2056 bp, Homo sapiens
  Payload ID: 6483
  Gene Symbol: FUT11
  Gene Name: fucosyltransferase 11 (alpha (1,3) fucosyltransferase)
  Uniprot ID: Q495W5
  ENST ID: ENST00000372841
  CDS Start-End: 44-1522
ggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccggtactgctgtggtggagcccagggctattcccccacttcccgggagactcggagcgcatcgagtgtgcgcgcggcgcgtgcgtggcgtcccggaaccgccgagcgctgagggactcgcggacgcgcgcgctgctcttctacggcacagacttccgcgcgtcggccgccccgctgccgcgcctggcgcaccagagctgggcgctcctccacgaggagtcgcccctcaacaacttcttgctgagccacggcccgggcatccgcctcttcaatcttacctccaccttcagtcgccactcggattacccgctgtcgctgcagtggctgcccgggaccgcctatctgcgccgcccggtgcctccgcccatggaacgcgcggagtggcgccgccgcggctacgcgccgctgctctatctgcagtcacactgcgacgtgccagcggaccgggaccgctacgtgcgcgagctcatgcgccacatcccggtagactcctacgggaaatgcctgcagaatcgggagctgcctaccgcgcggctacaggacacagccacggccaccaccgaggatccagagctcttggctttcttgtcccgctataagttccacttggccctggaaaatgccatctgtaacgactacatgacagaaaaactgtggcgtcccatgcacctgggcgctgtgcccgtgtaccgcggttctccctctgtgagggactggatgccgaacaatcactccgtcatcctgattgatgattttgagtctcctcagaagctggcagagtttattgactttctggacaagaatgatgaggagtatatgaaatacctggcatacaagcaacctgggggcatcaccaaccaatttcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggagatcttattctaccatgggacataaggagcatccactgcacaaacccttaatgaacactgtcttttcatggattcaaggaattccagttttatctattaagattttatcttaatgatgagtagccaaggtctaacatagggcctctcctcaaggagagatggagggatacaattcttggttcagtgggaaacagaaccctaaaacatccatttgattcaaggtgctggtccaacagagtttttaaactactcacttctttatttcatcctttcgactgtacttgattaccagtgaagtaagatgggtcaggttacgacttacaacttttgttctattccccagactcctcattattcagtacatttcccaataatctctttttctcatctcttgctttataaattgttacgttggtggagaagcaaaacatttggtgagttgtattctggttttccggagttggatttttttatattatatactttcatgtcaaa

SEQ ID NO: 135444 - DNA, 2175 bp, Homo sapiens
  Payload ID: 6483
  Gene Symbol: FUT11
  Gene Name: fucosyltransferase 11 (alpha (1,3) fucosyltransferase)
  Uniprot ID: Q495W5
  ENST ID: ENST00000394790
  CDS Start-End: 44-1474
ggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccggtactgctgtggtggagcccagggctattcccccacttcccgggagactcggagcgcatcgagtgtgcgcgcggcgcgtgcgtggcgtcccggaaccgccgagcgctgagggactcgcggacgcgcgcgctgctcttctacggcacagacttccgcgcgtcggccgccccgctgccgcgcctggcgcaccagagctgggcgctcctccacgaggagtcgcccctcaacaacttcttgctgagccacggcccgggcatccgcctcttcaatcttacctccaccttcagtcgccactcggattacccgctgtcgctgcagtggctgcccgggaccgcctatctgcgccgcccggtgcctccgcccatggaacgcgcggagtggcgccgccgcggctacgcgccgctgctctatctgcagtcacactgcgacgtgccagcggaccgggaccgctacgtgcgcgagctcatgcgccacatcccggtagactcctacgggaaatgcctgcagaatcgggagctgcctaccgcgcggctacaggacacagccacggccaccaccgaggatccagagctcttggctttcttgtcccgctataagttccacttggccctggaaaatgccatctgtaacgactacatgacagaaaaactgtggcgtcccatgcacctgggcgctgtgcccgtgtaccgcggttctccctctgtgagggactggatgccgaacaatcactccgtcatcctgattgatgattttgagtctcctcagaagctggcagagtttattgactttctggacaagaatgatgaggagtatatgaaatacctggcatacaagcaacctgggggcatcaccaaccaatttcttctggatagtctgaagcatcgggagtggggagtgaatgatcctttgctgcctaactacctcaacggcttcgagtgtttcgtctgtgactacgaactggctcggctggatgccgagaaagcccacgcggcctctcccggggacagccccgtctttgagccccacattgcccagccctcacacatggactgcccagtgcccacacctggctttggcaatgtggaagagattcctgagaatgacagcagtcttgtccaagttagagaccactgtatctgcttaagatttctttggccccactcggaaaaaggcaggactcataactatgctgcagttccataatccaacccccattttgatatttcagttggaaagagatgtggctgcaagattattggcaaggtctggaccagggggaagctctcactgccatgatccacaacaatgaaacagagcagacgaaattttgggattacctacatgaaatcttcatgaagaggcaacatctctaagtgcccttgcaagagcctttaacttggcggagctaaggagatcttattctaccatgggacataaggagcatccactgcacaaacccttaatgaacactgtcttttcatggattcaaggaattccagttttatctattaagattttatcttaatgatgagtagccaaggtctaacatagggcctctcctcaaggagagatggagggatacaattcttggttcagtgggaaacagaaccctaaaacatccatttgattcaaggtgctggtccaacagagtttttaaactactcacttctttatttcatcctttcgactgtacttgattaccagtgaagtaagatgggtcaggttacgacttacaacttttgttctattccccagactcctcattattcagtacatttcccaataatctctttttctcatctcttgctttataaattgttacgttggtggagaagcaaaacatttggtgagttgtattctggttttccggagttggatttttttatattatatactttcatgtc

SEQ ID NO: 135445 - DNA, 1593 bp, Homo sapiens
  Payload ID: 6484
  Gene Symbol: FUT2
  Gene Name: fucosyltransferase 2 (secretor status included)
  Uniprot ID: Q10981
  ENST ID: ENST00000391876
  CDS Start-End: 44-1075
ctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcatt

SEQ ID NO: 135446 - DNA, 3111 bp, Homo sapiens
  Payload ID: 6484
  Gene Symbol: FUT2
  Gene Name: fucosyltransferase 2 (secretor status included)
  Uniprot ID: Q10981
  ENST ID: ENST00000425340
  CDS Start-End: 118-1149
accgatgctggaagggtttctttggccctgagtgaagagagacccagagggaacactgaggtgcctgcccaaccactctgtcccggtttccttcagcaggaccaggtgagagaagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaattatgactttgcggatggg

SEQ ID NO: 135447 - DNA, 771 bp, Homo sapiens
  Payload ID: 6484
  Gene Symbol: FUT2
  Gene Name: fucosyltransferase 2 (secretor status included)
  ENST ID: ENST00000522966
  CDS Start-End: 112-771
agtcaccgatgctggaagggtttctttggccctgagtgaagagagacccagagggaacactgaggtgcctgcccaaccactctgtcccggtttccttcagcaggaccagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccgg

SEQ ID NO: 135448 - DNA, 2584 bp, Homo sapiens
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENST ID: ENST00000303225
  CDS Start-End: 636-1721
gttcccacttcctccccgccccaggaaacctgccatggcctcctggtgagctgtcctcatccactgctcgctgcctctccagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccag

SEQ ID NO: 135449 - DNA, 2024 bp, Homo sapiens
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENST ID: ENST00000458379
  CDS Start-End: 73-1158
aggaaacctgccatggcctcctggtgagctgtcctcatccactgctcgctgcctctccagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggca

SEQ ID NO: 135450 - DNA, 2239 bp, Homo sapiens
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENST ID: ENST00000589620
  CDS Start-End: 291-1376
tctgttcccacttcctccccgccccaggaaacctgccatggcctcctggtgagctgtcctcatccactgctcgctgcctctccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccag

SEQ ID NO: 135451 - DNA, 567 bp, Homo sapiens
  Payload ID: 6485
  Gene Symbol: FUT3
  Gene Name: fucosyltransferase 3 (galactoside 3(4)-L-fucosyltransferase, Lewis blood group)
  ENST ID: ENST00000589714
  CDS Start-End: 247-567
aggaaacctgccatggcctcctggtgagctgtcctcatccactgctcgctgcctctccaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatc

SEQ ID NO: 135452 - DNA, 754 bp, Homo sapiens
  Payload ID: 6485
  Gene Symbol: FUT3
  Gene Name: fucosyltransferase 3 (galactoside 3(4)-L-fucosyltransferase, Lewis blood group)
  ENST ID: ENST00000585715
  CDS Start-End: 622-754
gggtggggcagaaacagatcacaatggtggaatgtcatcagctaaggctattttcacttcttttgtagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatccc

SEQ ID NO: 135453 - DNA, 2182 bp, Homo sapiens
  Payload ID: 6485
  Gene Symbol: FUT3
  Gene Name: fucosyltransferase 3 (galactoside 3(4)-L-fucosyltransferase, Lewis blood group)
  Uniprot ID: P21217
  ENST ID: ENST00000589918
  CDS Start-End: 234-1319
gttcccacttcctccccgccccaggaaacctgccatggcctcctggtgagctgtcctcatccactgctcgctgcctctccaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccag

SEQ ID NO: 135454 - DNA, 577 bp, Homo sapiens
  Payload ID: 6485
  Gene Symbol: FUT3
  Gene Name: fucosyltransferase 3 (galactoside 3(4)-L-fucosyltransferase, Lewis blood group)
  ENST ID: ENST00000587048
  CDS Start-End: 278-577
ctttagctccagccacctctttaagaggaaactgttgggcagatggaggagggctagtcacggaaagaaactaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctacggacatggcctttccacatccctgtggctctgtcccgctgttcagagatggtgcccggcacagccgactgccacatcactgccgaccgcaaggtgtac

SEQ ID NO: 135455 - DNA, 599 bp, Homo sapiens
  Payload ID: 6485
  Gene Symbol: FUT3
  Gene Name: fucosyltransferase 3 (galactoside 3(4)-L-fucosyltransferase, Lewis blood group)
  ENST ID: ENST00000587183
  CDS Start-End: 586-599
gctgaggaagaattgggacctagctcggcctgatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctggg

SEQ ID NO: 135456 - DNA, 6059 bp, Homo sapiens
  Payload ID: 6486
  Gene Symbol: FUT4
  Gene Name: fucosyltransferase 4 (alpha (1,3) fucosyltransferase, myeloid-specific)
  Uniprot ID: P22083
  ENST ID: ENST00000358752
  CDS Start-End: 295-1887
ctccctccctcaatccctccctccggcgggcgtcgctggcgggtggctaggcccaacggcaggaagccgacgctatcctccgttccgcggcgccgggtccgccttccgtctgttctagggcctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaggaaaaaaagtttcatgatatctgttgttggcagtttttgtttatctctgacagtttttagttaaatgtttagatcctcagaactacattagtgcctactattaacttactctgtctcttgttaaaggctaaatctgcgcttctccctggtgccagcaggttcccctcacagtcaatgcagtggtatagcatatcctcacatttctagtgcccttgagactgtgctatggaaccaatcttgaacatacatgcattgacttgacaagttactgagtaagcagcatattcagcaggtgccactacatgcctactctgccagacactgagcttggggccctagggaagatagagaattatacaaggcaaagtccttctctttagggctcttacaatctatcacttccaaaaagtaaatggtgactgataaaacaattggcagaacctgtttgattactgtgacagtcttaatgataccataaatcaatattagaaagctagttgacttaaagcctgaaataatgggagttttctcctccacttattagaataaggaccctcagtgactaattattgtgggtagggtcaagattaactagttttatacagagttctgctgtaaatagtcattttgcatttgattagtgcagttctctgaatcataaagcaagttttacctctctgtacatgtttttgcagacatacttgaaaagctcacttaaatctaggtgcttcaattcactttcttgagaggacaaatgaaaagctgtggagaaaatgtcctcattaaagtattaaagtgtgggcagaattacaattacaaagtgccagccaccgaataaagataaaagttcagttcttaaaatgagtttttatgagataacagtcagtgatcttggtgttaccgggattccacatggggcagtgggaaagagttcaggttttgaaggtaacctagtttagatttgaattccagctatgtgacattgggtaaattagtagtagtcctgagcctcagcgtcctcatctataaaatgactggcgaaaatacttcacaagctcattttgagcactttaggaagtaagtgaaagtacctaaaatagcaggcacccaattgatgattttatatcttccttctttgcttgcagtgatttcaggatgtcctcatatctatttataggtctaaaattatatcttaaggtatgttgtagaataaattaaaaggataatctaaatcaccatttagattaagcttgacttgcaaactaggaagaagcacctaggctttctttgaaaatatttttttggttcgttttggtaaagctctataaattggtatctattattttaccaatttttttttagtattaagtccatttagaactaaccatattatttatggaataattagcatgaggaaggtataattgcatttttttttttttgagacggagtcttgcactgtagccccagctggactgcagtggcgtgatcttggctcactgcaacctccgcctcccaggttcaagcgattctcctgcctcagcctcccgagcagctgagactacaggcgcctgccaccacgcctggccaattttttgtatttttagtagagactgcgtttcaccatgttgggcaggctggtcttgaactcctgaccttgtgatccacctgcctcggcctctcagagagctgggattacaggtgtgagccgccgtgcccagccattgcatttttattcacatacacattgttaatgtggaacaatttaacactaatctcatcagagagcgagatgaatgtggcaattgctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacggtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggtgctttgtatattgtaaagtgctatataattataagatgttctaaattttcaaggatctaaaccagggattggcaaacgtttttccagggagtaaatattttacgctttgcatatataatttatggaggtgttgagaggatagattagacacttgaagtactcaggatagtgcctggcatgtaggaagcacctggaaaatattcgctgtgattaccatcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaattatatatatagtatattatatatatttttaaagctttatatgcctcaaatatcagggaaaggagccaagtccttggtatttagtttggtgaatacttgcattgaatacatgtcaagatgtcaagtcatttttgaatgtgtctcagggatttctatgctacacattcttttaacaaatcaagtatttatgtacacatgttcagattttttgacaaaatgattaaaataatgagatggaaaatga

SEQ ID NO: 135457 - DNA, 1916 bp, Homo sapiens
  Payload ID: 6487
  Gene Symbol: FUT5
  Gene Name: fucosyltransferase 5 (alpha (1,3) fucosyltransferase)
  Uniprot ID: Q11128
  ENST ID: ENST00000252675
  CDS Start-End: 17-1141
ccagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttggttcacctgagaggccggcatggggcctgggctgccgggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgcccaaggtgtgcagggcaggtcagggaagggcagggtcccctaaggaggagggcgaagggtatgtgtgtgaccatcagcagtggtgtgcacatggctgggggacactcggtttgaccgccagcggatgggtgtcacaaatgcatcactatgggtgtgacctcggcgtgactctgatagtgcctgtggatgtgttgcgatgcctcaccctggagggcactgggccctgagaacgggtgcccttgaggccctgcccccgggcgatggtgcaggctggtttgcttgtggttttattgctgttgttaaccacccatgaggggtgcaaacagataatgctgttaacattttca

SEQ ID NO: 135458 - DNA, 1988 bp, Homo sapiens
  Payload ID: 6487
  Gene Symbol: FUT5
  Gene Name: fucosyltransferase 5 (alpha (1,3) fucosyltransferase)
  ENST ID: ENST00000588525
  CDS Start-End: 89-1213
gattacagacatgagccacctcgcccagccttttcatggctgagtgatattccattgtgtggatggatcacactagctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttggttcacctgagaggccggcatggggcctgggctgccgggacctcactttcccagggcctcacctacctagggtctcactagtcgggggatttacctacctggggcctcggctgcctggggcctcggctgcctggggtctcacctgcctggggcctcacctgctggagtctttggtggccaggcatgtgacttacctgggatttcacttgccgggcttcactgccaggagcctcccctgctggggaccttgccagctggggctggggatggtgcctactggggaccttgctttctggaggctgcacctactgaggatctcggctgttggggactttacctgctgggacctgctcccagagaccttgccacactgaatgtcacctgctaggagcctcacccgctgggaggcacagggcccaagggagctggatgtgttgcccaaggtgtgcagggcaggtcagggaagggcagggtcccctaaggaggagggcgaagggtatgtgtgtgaccatcagcagtggtgtgcacatggctgggggacactcggtttgaccgccagcggatgggtgtcacaaatgcatcactatgggtgtgacctcggcgtgactctgatagtgcctgtggatgtgttgcgatgcctcaccctggagggcactgggccctgagaacgggtgcccttgaggccctgcccccgggcgatggtgcaggctggtttgcttgtggttttattgctgttgttaaccacccatgaggggtgcaaacagataatgctgttaacattttca

SEQ ID NO: 135459 - DNA, 2847 bp, Homo sapiens
  Payload ID: 6488
  Gene Symbol: FUT6
  Gene Name: fucosyltransferase 6 (alpha (1,3) fucosyltransferase)
  Uniprot ID: P51993
  ENST ID: ENST00000286955
  CDS Start-End: 1054-2133
agatcatttctctccattccaggaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaa

SEQ ID NO: 135460 - DNA, 3137 bp, Homo sapiens
  Payload ID: 6488
  Gene Symbol: FUT6
  Gene Name: fucosyltransferase 6 (alpha (1,3) fucosyltransferase)
  Uniprot ID: P51993
  ENST ID: ENST00000318336
  CDS Start-End: 1196-2275
aaaaccagtattccagatcatttctctccattccaggaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctc

SEQ ID NO: 135461 - DNA, 2598 bp, Homo sapiens
  Payload ID: 6488
  Gene Symbol: FUT6
  Gene Name: fucosyltransferase 6 (alpha (1,3) fucosyltransferase)
  Uniprot ID: P51993
  ENST ID: ENST00000524754
  CDS Start-End: 641-1720
gtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtgccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctcaaaaaaaaaaaaaaaa

SEQ ID NO: 135462 - DNA, 530 bp, Homo sapiens
  Payload ID: 6488
  Gene Symbol: FUT6
  Gene Name: fucosyltransferase 6 (alpha (1,3) fucosyltransferase)
  ENST ID: ENST00000532464
  CDS Start-End: 397-530
gttactccgtccgcggcctctcagctctagggccctctgcacactggcccccccagagctctgcggtagaatcccgtgccccccgaccccatcagcagcctacaccccttcatccttcctggccccggattttctctgcctctgccactcccggtggtaaaagagggcttagaatgcggtttgctttctggctttgtttttttgcatcctgatctttgtggcgtggatcgatcattttccagggaaagtaccttggtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccc

SEQ ID NO: 135463 - DNA, 682 bp, Homo sapiens
  Payload ID: 6488
  Gene Symbol: FUT6
  Gene Name: fucosyltransferase 6 (alpha (1,3) fucosyltransferase)
  ENST ID: ENST00000531085
  CDS Start-End: 476-682
tgtcacgggcatccagacgggatccagtgcatcctcttttagaagaaaggcctgtctccagatccccgagtccctctagcatctcccagaaggtgtcagacgcagcagtgtccagggagcggcagcaggtccttatcatggtccaagggtccctcccagcctccaagtctcaccccatacatgaaaaaaggtggccccggtttcccgccacctcctccacagcaccatctctttgaagacccagtgcccacactccgggggatttgggccctcccctgtctccctccagccccctggggccagtccgctgctgggtatctccaggacgggccaggctcagcaagttccaccaaagcctgcttctctcctgggggttccccatgtctctgggtggccccactgccctcctggtcagcatattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtgg

SEQ ID NO: 135464 - DNA, 2211 bp, Homo sapiens
  Payload ID: 6488
  Gene Symbol: FUT6
  Gene Name: fucosyltransferase 6 (alpha (1,3) fucosyltransferase)
  Uniprot ID: P51993
  ENST ID: ENST00000527106
  CDS Start-End: 270-1349
gcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctc

SEQ ID NO: 135465 - DNA, 527 bp, Homo sapiens
  Payload ID: 6488
  Gene Symbol: FUT6
  Gene Name: fucosyltransferase 6 (alpha (1,3) fucosyltransferase)
  ENST ID: ENST00000528505
  CDS Start-End: 437-527
ctcagaatccagctgttactccgtccgcggcctctcagctctagggccctctgcacactggcccccccagtgggtgtctgtctgtctctcttgcagagctctgcggtagaatcccgtgccccccgaccccatcagcagcctacaccccttcatccttcctggccccggattttctctgcctctgccactcccggtggtaaaagagggcttagaatgcggtttgctttctggctttgtttttttgcatcctgatctttgtggcgtggatcgatcattttccagggaaagtaccttggtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttct

SEQ ID NO: 135466 - DNA, 564 bp, Homo sapiens
  Payload ID: 6488
  Gene Symbol: FUT6
  Gene Name: fucosyltransferase 6 (alpha (1,3) fucosyltransferase)
  ENST ID: ENST00000531199
  CDS Start-End: 365-564
acttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcaggtccttatcatggtccaagggtccctcccagcctccaagtctcaccccatacatgaaaaaaggtggccccggtttcccgccacctcctccacagcaccatctctttgaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtg

SEQ ID NO: 135467 - DNA, 700 bp, Homo sapiens
  Payload ID: 6488
  Gene Symbol: FUT6
  Gene Name: fucosyltransferase 6 (alpha (1,3) fucosyltransferase)
  ENST ID: ENST00000529165
  CDS Start-End: 290-700
gtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggag

SEQ ID NO: 135468 - DNA, 1095 bp, Homo sapiens
  Payload ID: 6488
  Gene Symbol: FUT6
  Gene Name: fucosyltransferase 6 (alpha (1,3) fucosyltransferase)
  Uniprot ID: P51993
  ENST ID: ENST00000592563
  CDS Start-End: 1-1095
atggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccagtgggggcctcatctacctaaggactcgtttgcctgaagcttcacctgcctga

SEQ ID NO: 135469 - DNA, 2584 bp, Homo sapiens
  Payload ID: 6489
  Gene Symbol: FUT7
  Gene Name: fucosyltransferase 7 (alpha (1,3) fucosyltransferase)
  Uniprot ID: Q11130
  ENST ID: ENST00000314412
  CDS Start-End: 1020-2048
ccaggctccaggccctggcttagagggagcggggagtctggacttcaggctggatcccttcctcttcctggagcgggtgctggcccccaacccgcttgcgtcagggacaaaaggactccttccctttccagcctggaaagcccctctgctgcaggctggaggaagggaccctgggcccagcctatagtcagcggtgtctatgggcatggatctggacggggaaaaggacaaagcagcctccatccacagttcattccgggaccaggcccttgcaggcacgcgctgggctcctgtgggaagacactaagggccccaggacagacctcctctccgggcatctgggttcctagatggcagaggtggcagagtggggtgggatggcccaattgggagctttagcttccggcaaagagctgagcacagtacatcttcaatgtgtaagattctcctgggagaccagggcccagctggtggtgagctgggggaagtgggtgatactgccgtgggaggagccacctggccctctggggaagtgcactcgctgtctgcagcgcccaggcctgggtagctgggtgggggctggggggccatctgtgctcagggtgcctgcacctgggccttctctgccctgggccaagcctgcccgagcctctctgtcctctgcctgcccagctggacatctctgggcctctctggagaccagtggggtgggctgtgggggcgtcatattgccctggcttggcatccctcttgtggctgtacccctcccagcagccccaggactagcaagtccccgagatgggggtggggacagtggttgatgccaaaggttgtgggggcaggggcggggcaggagcaggaaggtcccctgagttccctcaccttgggcagagataaaaggagcacagttccaggcggggctgagctagggcgtagctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacatctgagcagtg

SEQ ID NO: 135470 - DNA, 2490 bp, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENST ID: ENST00000342677
  CDS Start-End: 455-1381
gactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaa

SEQ ID NO: 135471 - DNA, 2664 bp, Homo sapiens
  Payload ID: 6490
  Gene Symbol: FUT8
  Gene Name: fucosyltransferase 8 (alpha (1,6) fucosyltransferase)
  ENST ID: ENST00000358307
  CDS Start-End: 592-1932
gctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcaggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggattctgatggcaattactgtctcattagtgaacaataaaagaaaaattgttgtattagcacaacctactactgtgaagaggaaaagaattaccccatacaagtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaa

SEQ ID NO: 135472 - DNA, 5166 bp, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENST ID: ENST00000360689
  CDS Start-End: 1728-3455
tttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaaactatcatgattattaaccaactagaagtagttcttttttttaaattttatttttaattttagacatgagggtcttgctatgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaaactaagaagtaaatatccaccccacctctgacttctaaaaattatctaaagtatgactggtaagatttttacctttaatcccacataagtctaaaatttgtgttcatttccaacaaccaaagtgtgtcacttttataccagaattttgtcctgcttatacgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaacaa

SEQ ID NO: 135473 - DNA, 3559 bp, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENST ID: ENST00000394586
  CDS Start-End: 1100-2827
cgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcggcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaa

SEQ ID NO: 135474 - DNA, 727 bp, Homo sapiens
  Payload ID: 6490
  Gene Symbol: FUT8
  Gene Name: fucosyltransferase 8 (alpha (1,6) fucosyltransferase)
  ENST ID: ENST00000553924
  CDS Start-End: 681-727
gcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttt

SEQ ID NO: 135475 - DNA, 583 bp, Homo sapiens
  Payload ID: 6490
  Gene Symbol: FUT8
  Gene Name: fucosyltransferase 8 (alpha (1,6) fucosyltransferase)
  ENST ID: ENST00000555559
  CDS Start-End: 462-583
agcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagattctattttgaccagcaataagttgaattatggggctagaagataaggactaaaaacaagaattggtgtccagaaagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccg

SEQ ID NO: 135476 - DNA, 751 bp, Homo sapiens
  Payload ID: 6490
  Gene Symbol: FUT8
  Gene Name: fucosyltransferase 8 (alpha (1,6) fucosyltransferase)
  ENST ID: ENST00000557338
  CDS Start-End: 600-751
gtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagattctattttgaccagcaataagttgaattatggggctagaagataaggactaaaaacaagaattggtgtccagaaagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttga

SEQ ID NO: 135477 - DNA, 632 bp, Homo sapiens
  Payload ID: 6490
  Gene Symbol: FUT8
  Gene Name: fucosyltransferase 8 (alpha (1,6) fucosyltransferase)
  ENST ID: ENST00000554667
  CDS Start-End: 494-632
gatgatcctagtagaagtcaaatgagatcatttttgatagttggtttgcaggcttcggtgtatgcacccaacctttcaaagactgcctgtgcttttcagggagctcagttttgtgactgaaaggatcagctattctcttctacctttttaatgcactactggtttctagcagctgctgcttaacgctgttcattcttgagtttggtgaattgttttctgtgctccatgtgatttctttgtctttatgaggtacattttgactacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattc

SEQ ID NO: 135478 - DNA, 554 bp, Homo sapiens
  Payload ID: 6490
  Gene Symbol: FUT8
  Gene Name: fucosyltransferase 8 (alpha (1,6) fucosyltransferase)
  ENST ID: ENST00000554610
  CDS Start-End: 421-554
agtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctgggcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaa

SEQ ID NO: 135479 - DNA, 2269 bp, Homo sapiens
  Payload ID: 6490
  Gene Symbol: FUT8
  Gene Name: fucosyltransferase 8 (alpha (1,6) fucosyltransferase)
  Uniprot ID: Q9BYC5
  ENST ID: ENST00000557164
  CDS Start-End: 505-1743
gtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcaggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttt

SEQ ID NO: 135480 - DNA, 639 bp, Homo sapiens
  Payload ID: 6490
  Gene Symbol: FUT8
  Gene Name: fucosyltransferase 8 (alpha (1,6) fucosyltransferase)
  ENST ID: ENST00000556518
  CDS Start-End: 551-639
gcgactactttgtgtgctggggcggcgcgctccggtcctcccgctcagctggcggtctgggctgctctggggcagcccttcggtccactgctctgcatcgcgggcgccgggaattttccgagtccgagcggagacagggtttctctgtgttgcccaggctggtctcgaactctgagctcaagcgacctgcccacctcggccacccaaaatgttgggattacaggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggt

SEQ ID NO: 135481 - DNA, 12783 bp, Homo sapiens
  Payload ID: 6491
  Gene Symbol: FUT9
  Gene Name: fucosyltransferase 9 (alpha (1,3) fucosyltransferase)
  Uniprot ID: Q9Y231
  ENST ID: ENST00000302103
  CDS Start-End: 327-1406
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgatttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagttgggatctgacaaatttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctacttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgttttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactccgaagatgaatgaagtgtataactgtctctatttgatctattttttttacctgtttatcacatttgtgaaggtgaaattattcatggagtgaataagaaagatatgaagcagaactgttctattcgggaagctattagacttctcatttattttcattaagctgatttgcagctacttattctcatggtcttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggtcttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacacagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggctagaggagagctggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagcaccagaaagatttgagcagaggaatattcctgtaatgaatagaggattgtttgattctcaggtatatttcttaagccaagattgaatgcagtgtcaggcactgccttaacacccacagagataagatgaacaaggtactatcactgcctaaaatgagcttacaattaagtggatagacatataaaagcttcctttcaattcagcctgagactgtttatatgcatgtgctactccgaatgacgtttgtatgggtcaatgctgatttaatggggaaaaaaagtagaaaatttccccaattgcttagctgtttgacatgtttctgagctgcaaactttgtcaactcttttgacccaacatattattctctccgtattatctcttctaaccacaatgcattaagaaataatatttttatgtggatgtcctcctcaataagtaaagatctccatccatatttaattaattggtaagacagtcaaattcatacatttacatttactttgtcaaattttttggtctataaaaagcatagagatctaaagaggatacactgctaacaagtttagaaagcacctgcttttttttattattattatttttgtgatagagtcttgctctgtcgcccaggccggagtgcagtggtgcagtctcggctcactgcaacctcggcctcccaggttcaagtgattctcctgtatcagcctcccgagtagctaggattacaggcgtgtaccactatgcctggctagtttttgtatttttagtagagatgggtttcactgtgttggccaggctggtcttgaactcctgacctcaaatgatccacttgcctcagcctcccaaagtgctgggattacaggtatgagccactgtgtctggcccacctgttttttttgaaggcagaaaaacattcaatattaaaagcattcaatattatttcaacctgccttggctctagtgaatgttcatgatttgaaagaactgaaagacctaaaggcagtgtctctattgttgactacaaatgtaggctctttgttggactatgactataatcacacactgataatatgacgcaagtagaggcagtactactaagtatctagcaggtgctttgaaaccccattactaagtcccagaagactgtttcctaaatttgaagtggaagaattaaatgactcaatggaaccctttagctgtgggtccattgatgtgtgagttttagagctggaaggaattataattttgttgtttataattgctataatatagaaattataattgcttttctttctacttatgagttaactagatccagagatatttattcaagacacacattcacacacacatacacacacacacacacacaccccacagctagtgacaatagttaagatttggatttaaggatcctatctttctttatcccactttcttttcaatcgcattcataacttattatagaattatgtctcaatttttacaaatgtgaatgtcttattggtatttttagggcctatagaatggtacacctcatgtagaagaacttcgacttttgaaggtatacaataaataaaacatcaaacttgttagcattcgttctggtttaaatattttaggagttgagttcagcagaaggaaatgggctatcactacatttaagtgaaatacaaccctcaagaaagtgtatggttcacagccactcctttaataaatcctgtgggttgcaattctttgtaagaaactcatgaaaaagatatattgattcaacaaaattggtttgctgttgattatacaaaccaataattatgcctagaattaaattgtggacacaaaaaagggaacagaccatttaaaatgttttatttcaaaatatcgaaaagctattaccttcaatactctaaatatttaaatattaattattgtagacatcagtaagaataaataaatgttaatcattatagaccttactaataagaatatatactgaattgtccacatccagagtattacaccctgaacaagaaagacatgagagcctgacagtcatatatattatgacagctgtatatctgacaatatgaagtagaaactgaaaaaaaaaatcatcttagtgggaaacaaatacatgcttaaaattgttatatttactgtaaaactcctgataatcttagattgtgcagaaatgtttcttattttgaggggcttagaaagctcagcgcatttgatgtataaagcaacagaatatttaggaattatttgcggaggctttaaattcttacctccaattggaggttaaatattaaaagaataggaaactatgcctctgatattttttttgtcagcctatttttaaactagattccatgagtcttaaggtaatatcctagaattttttttttgcgtgaattaaagttaccacaaatttcaggtccttaccttatgactgtgtttgatcatatctttgagttcccttgaactctgatctcattttgagaaacattttgagaaacttcttaacaattacaatcgagctgttaaatataacaaacatcagaatctaaaggataagcacagtgcctaatgtacaggagggtcatatcaaatacttgttgaataaatacatgaatgtgataagtggtcctgtaaaatattttttaagagtagtgacaatgtttattggtaccaattggagatgatattttatatttattttgttagtttgtcacctggatgcaaaaggaaggcattttaattcctttctatcttacaacattgtaaagcatcaaaagaagtaacatctcaagaaagattagaaaggatttggatcacgttaacattctatgcaaatattagtaacatatcaactgtttctaaaaggaaagaaaattagtatttaaggagagtataaagtgcgagcactgtgaagggcagatatctattaccaaaccacatggagagaaatatagtctctctcctaacttcattccattgtattgcaatcagtcaattaaggtgattttttttttctggatgtctcaatctagagattttgtagcattttgcaaatgggtatgcttcactactatccacagtgttctcccctttagtaattcatattgaatatatccatattcatatgcattttataaaacagttaacagaatctaaataagatatagccggctaaatctggaatgtgagtgctaccctaggttattagttcaacaaactaattttgagagagccacttaacctctctggaccttgtttgtaagctttcttctagcactattactcttatctaagatcgaaattgatatatgcatgaaattcctaatggaatttcaatgtccatctcaaagtaattttttaggatattccatacagatttccttctcatttctctgtgtagatatttaaagtatgaaattgattatttaaactaatatgtggaaagaacctaatccagagcttggaatatagaaagtgctcaattaactgacattcctcctgtatttcctccctccccttagttgtctatgacttttgaactcactgctcactgacatcttaattgcctgcagaaaaatcaatcatattttaggcattattttgaaatattttagagttttctgtactattcaaactcttattacaaaaatctaaagatatttattgatgcaaaaaatttagggagtcattggaaatacctgaggcaatcccaggctaacaataaaatagcataattttaagtaagctagattgagttcatttgaacatttagttattttttagctcatagttaacatatgtccatgcatttgatttactttaaaaatattttatttaaaaataacctctcaaacaccagttgctttctgtcagttttactcaaagcatgcttcctaggtcacctgacctagaatcaccagaagtgttaacaataccgatttctgggctttgagccatgaaattagaatttcttcaaataatccatgcccccccgtcacccaaaaaaagagcatgcttttaatacatttccaaaattatcctgtttctgctataactggtgaaccatcctgtcctaaactagcagttctcaaacatgcatatgcctttgaaacttcctagatcatctacataaaaatcatttgaaatattgttaataatacacagcttctgaatctctgggtgtgagatgggaccaggaatcttattttaaaaatctccccagatggttctggtgtcctgctagttttgaggttttcatcccacctgtttagatgggtagtattctattaaatatgaggtattacctttctttagttcacctggaatcttcttaaatatatcggtaaagtattctacttcaaaatccaagacattttgtatacctaattatttcacacaagagcgtggaactcaccagtcttgtgacttggggcaggttatttatagtctccagacactttttccagttgcgagttgcttatagtagttcgcgaacctgaatgcacattagaaccatctggagaggctttaaaattgcagatgtccaaaccccacctccagagagctgatctatttagtttgaggaagagcccagaagtctaacaggtgtaaatgttccacaggtaatactaatgcaggcatacctcaggaaatcaccagttctcgtcttggaggaactattaggaaaataaaagattatatatcttgaaaaaaatctctaatttgctttctaggttctaactgcatgtttatattttgcaacaggaaagactggtctagacaattactaggatatatgcttctgtgatctgcttttctattgtatgtgtttaagagaccacattcttgggttccaaagtctccttgtctgataggtaatttgcaattgagatatggcaaagaattgtagcatccaaatttttgacaactacagatttagaattgaatccaaggtctgccattcactagctatgtgcaagttactcaacttctcttatcctcagattttgcagctgtaaagcagaggtagcatatttctgagaaattatattcaggtgactagatatgtgttcaagtgttatcttttattcttataaaagataattgtgaggaatccagtgctattttcacaattttaattctaaaactctgaagacattaaacaggcagtttgtaggaatcattgaaattttatacaagccgaaggaacaacattcagcaaaacggaaacaaataaatacagcatggaagcatatattcatgtttcccataattactaagttacggaaggggtgtgaggagctggcagtggtggtgaataggcattgtttgcattactaaatatatataccatttcttaagataattggaactcaagcagtcctaattttctctccctgttatgagcaatcagtaaatttgtagtcaatttaacttattatcagttggtatagcgcatgtcacagaataggatagcaagaagattctcagagatcattttctggtaaagaaaaaggcctagcaatatttaacagtttgacttaatccatcacttcagctggtccactagttttgacacaggactagttaatgatttgttaggaagtctccatctactcttaaactaatttaaaaaaaagctaaaagttgcttttaatatgttagggtataacttcaataaacaggagtatttatctagtggttcagaaataaaataattgttagccagcctgtgattaaggctaccataattgcataataaatagctttgacgtgaataatctcagttgttcaagtgtacaaatttaaagctgtactatgttagaataaaaaagtaggctcaaggaaaatttctatttttctatatgaaaaagagaatgatattcaaaatagtatttttaagtagtttctaattgtgttcctttaaagagtattagaaatgtctgttatgtcagtaacattagaaaacttcaaaaactgatttatttttctgagttctctggaaaccaaacaattttgaattagttgtgtaagtaaagtaagttaagttatagcttgctggaattttattgtggaaaacaaatatagattttatctgaaaaattttaagggccaattctacagaaagttatgctaacatgctaactttccacacatggctgcattccattttgattaatgagggttcaggaaatagaaaggcagtctctgcagaagcagtatccaaaggctaaattaacaacccaggactaccactcattatgtgagaaatatgggccagagttacaatatcacatctccagtctcagattggcctcattagccaccttcagttccttaaatgagataatcctgaagatgccatccttgtccaaggtgagattgccagaggatatgagctcatctaggatggaatacatgtctccagggactgtaatgagatcaggcttttcatttactggttttctgcctcaagagtccttaagcaaatgaagattatctgattgtctatgtaaacctggaagtagtctactttttagataaaagataatctatcttgaatatttcatatgtgattttaaaataattaatcaaaaaacaaagactatcatatttgagaacaagattttacttagaagggaaaaaaaagaactttcagcttaatcggggttaagggagtaattgtgacaatataaaatggcattgttatagaatccctaaaaggtaaataatgtatgagatgaaggtaggaagtaatgtgtgcttgcagaaatgcaactggtcaaaattacttgaatgaaattgttgaggttaaacatcttcattataataatatgtcttattctgattccaagacaatacgaatgtagagaagagatttttaaatggaaaaagtaaggagctaacaagtctgtacctagattcaagttcacaaagcggcaaaaaggagaaaagtgtcaacaagaaacaagaagaggagtagtaaactaaggatcaaagcccaagttccagttttcacaatctgctgtataattcactaacatttctgagccatagatttttaatctgtaaaaggagtgtgatggactgtacattagaagtacctgagaagctcttaataaatcttgatgaattggttagaaattctaatttaattagcctggcacagtgcacaaactgccatatattcgtgcagatgttttcttcttttcttactgcgcatttccatgtggccatgtcactacaaggggtggggaagaagttaatgtgtaattgcttcaggagctctgaataaaaggttgctgaagcaaaatactgcaatgaagttctgaaaatgaagagttaggactttacatgatttctcttgcctcattccctcaagaatgcacatatagacacacatatgccaatatcttttttatgtagttcaagtataactttgaataaaatgacttacattcaaggaaggtcaaaactattattctgaaacaaaatgtgacaattctagccattatgtgaattgtaagggtcagtaatccataaattatttggatggtaattgtatgttttattaatgtgatgtaattttgcactattgtattgtcatatttaatcaaactcttaaaaataccctgaaacataatgccaaatgtacagtttataggttcgtgttatttctgataagaatttaattgcattgtgctaatagttgtttattgctattaactttctgtgtatgtattattgcgatgcagacccaatagggttattttaagcacactaattagtcatctggatttttatagataaaatcacatgttgatcagaaatcatttttctacttatttttttgtagagtatttttccacacttgaaaaaaacatgattattttatatcaaacatcaacttttctttaaatcttattttagtagctaatgcatgtttgaaataagatgtgttagaaattatatgactatattaaggttgtgtttatattaggtgaaaaattgcatgcaattggtgaatcatgcagctttggggacatttacactgccactcacacacaggctctgtctcaatccgtatgcatgattcacgtcctttcaaaagtcccttttcaacatttggtaaagtgaaaatgttattcatagtgctaatgagccaataaacaatgctgcgtttcttttttctaactgcagcatattgtggtaaattttctcccaaaactttatttttggagttattgttggcaataaatacaacaaattatttgttggcaagtgatacaatttactgtataacaacttaatagtacaaagcatgaagatgtgaaaatatcatcttaaccagtttcattctatgaacataatattctggcagctttttctataactgagaatggtatatctttttatacactgcctaaatcagtactactgccagtcacctgaggtcaggtctgcacaacactaaattgggcaataacatagaacatctaggcagtcttgacagtcaaccagtgtaatcactaggggaagaaaaagtaggcctacccttttacttattaacttaagtaataaaaattgtataaaaatatgaatgttggctgcagaggagcctttacatgcagataatttgaagcagtctttgaaaataacaaaaattattccatttaatgaagggtttgttttgtttagcttttctcttttattcagaaaacatacctgtgcttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatagtgtatgtgtgtgacattcagctaacattgatctaggcacttagtttgctaccacattgttcccttcattgattgaaactgtaaataacataacactttaaggcagctaagcaaatattttaataagccatgaaaggcaagatgccagagaaaatctgtatattcagctatttggagaactcgtgttttccacaaattaaactggagatgtcatttgaaattttcttcccttaaacatgctgtcacaacatggattccttctcatggatgtctttctaggcttataaatatatggtgtgattgctataattttgtgaaattttattcagcaattaatagtgatttcagcaatatgtactaagattccaaggcagaaataaatgtataaaggatttgagcctgtatgtgtaagaagaaactctctcttcagtcatatttcctaaattcagtgtaagtacctcgctgatttagcactggagttattccttgaatgtgtaaataatgatgttctattctgacctaatgaattcctgtaatgtgaatatttaaaataaaagaattcaatttaaatgta

SEQ ID NO: 135482 - DNA, 7364 bp, Homo sapiens
  Payload ID: 6492
  Gene Symbol: FKTN
  Gene Name: fukutin
  Uniprot ID: O75072
  ENST ID: ENST00000223528
  CDS Start-End: 125-1510
gtaaagcggagcggctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttga

SEQ ID NO: 135483 - DNA, 2404 bp, Homo sapiens
  Payload ID: 6492
  Gene Symbol: FKTN
  Gene Name: fukutin
  Uniprot ID: O75072
  ENST ID: ENST00000357998
  CDS Start-End: 117-1409
tctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttga

SEQ ID NO: 135484 - DNA, 786 bp, Homo sapiens
  Payload ID: 6492
  Gene Symbol: FKTN
  Gene Name: fukutin
  ENST ID: ENST00000374705
  CDS Start-End: 81-786
cactatttatcaacaaagaatggagctggtttgtcaaaatccaaaggaagccgaattggatttgatagcacacagtggaaatgatccttgaggtgggagaaaataatggatttttttcaaagtctttacttccacggtacgcaagcaaaaagttgaagagcagcttaccacattcacgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattct

SEQ ID NO: 135485 - DNA, 1700 bp, Homo sapiens
  Payload ID: 6492
  Gene Symbol: FKTN
  Gene Name: fukutin
  Uniprot ID: O75072
  ENST ID: ENST00000448551
  CDS Start-End: 215-1507
aaagcggagcggctgcagcctgctgttgagtgagattgaaaggaaacacactgaatgaggaaaaactaacatacggtcatcaacatccttgtataacctagtttttaaaaaaattggatttcaaagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagct

SEQ ID NO: 135486 - DNA, 606 bp, Homo sapiens
  Payload ID: 6492
  Gene Symbol: FKTN
  Gene Name: fukutin
  ENST ID: ENST00000457847
  CDS Start-End: 1-482
gatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaa

SEQ ID NO: 135487 - DNA, 7036 bp, Homo sapiens
  Payload ID: 6492
  Gene Symbol: FKTN
  Gene Name: fukutin
  ENST ID: ENST00000602526
  CDS Start-End: 33-236
tcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcatatttcaccttatattgaaaatgttcatctttcttagaagactgcttattgagagcagagaccatatgtgctatttaatcatttgtattttttagcacaatgataagcatggtatctattggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgagggtctcactttgtcacccaggcttgagtgcagtggcacaatcttggctcactgcagccttgatctctcaggttcaagtgatcctcctggctcagacccccaagtagctgggactacaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaaccc

SEQ ID NO: 135488 - DNA, 2576 bp, Homo sapiens
  Payload ID: 6492
  Gene Symbol: FKTN
  Gene Name: fukutin
  Uniprot ID: O75072
  ENST ID: ENST00000602661
  CDS Start-End: 217-1602
gtaaagcggagcggctgcagcctgctgttgagtgagattgaaaggaaacacactgaatgaggaaaaactaacatacggtcatcaacatccttgtataacctagtttttaaaaaaattggatttcaaagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaa

SEQ ID NO: 135489 - DNA, 3332 bp, Homo sapiens
  Payload ID: 6493
  Gene Symbol: FKRP
  Gene Name: fukutin related protein
  Uniprot ID: Q9H9S5
  ENST ID: ENST00000318584
  CDS Start-End: 298-1785
gtcccggcggccattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaatta

SEQ ID NO: 135490 - DNA, 2801 bp, Homo sapiens
  Payload ID: 6493
  Gene Symbol: FKRP
  Gene Name: fukutin related protein
  Uniprot ID: Q9H9S5
  ENST ID: ENST00000391909
  CDS Start-End: 339-1826
cattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctattttt

SEQ ID NO: 135491 - DNA, 559 bp, Homo sapiens
  Payload ID: 6493
  Gene Symbol: FKRP
  Gene Name: fukutin related protein
  ENST ID: ENST00000600227
  CDS Start-End: 242-559
attgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagccc

SEQ ID NO: 135492 - DNA, 569 bp, Homo sapiens
  Payload ID: 6493
  Gene Symbol: FKRP
  Gene Name: fukutin related protein
  ENST ID: ENST00000596460
  CDS Start-End: 365-569
ttgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggctgagtgcagtggcatgatcatggctcactggctcaagccatccccccacctcagcatcctgagtggctgggaccataggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagact

SEQ ID NO: 135493 - DNA, 551 bp, Homo sapiens
  Payload ID: 6493
  Gene Symbol: FKRP
  Gene Name: fukutin related protein
  ENST ID: ENST00000600834
  CDS Start-End: 336-551
gagcagccttcccctcgcttccacctttgtggttatggagccccaaacctcttaggactctgcaccaggagaaggttgctaaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcag

SEQ ID NO: 135494 - DNA, 597 bp, Homo sapiens
  Payload ID: 6493
  Gene Symbol: FKRP
  Gene Name: fukutin related protein
  ENST ID: ENST00000600629
  CDS Start-End: 358-597
attgctccaagatggcggcggcggcggcagcggaggagatgctctgctgaggggcagttgctatggttacagggcctggaccttcctccggaaggtgagaaacaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtg

SEQ ID NO: 135495 - DNA, 633 bp, Homo sapiens
  Payload ID: 6493
  Gene Symbol: FKRP
  Gene Name: fukutin related protein
  ENST ID: ENST00000601299
  CDS Start-End: 147-633
gtcccggcggccattgctccaagatggcggcggcggcggcagcgggagcgcagctcagctgggctggaactgccctcctggaactcccccagcctacaacctaggaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacgg

SEQ ID NO: 135496 - DNA, 593 bp, Homo sapiens
  Payload ID: 6493
  Gene Symbol: FKRP
  Gene Name: fukutin related protein
  ENST ID: ENST00000593875
  CDS Start-End: 335-593
cattgctccaagatggcggcggcggcggcagagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcc

SEQ ID NO: 135497 - DNA, 548 bp, Homo sapiens
  Payload ID: 6493
  Gene Symbol: FKRP
  Gene Name: fukutin related protein
  ENST ID: ENST00000600005
  CDS Start-End: 207-548
attgctccaagatggcggcggcggcggcagcggaggagatgctctgctgaggggcagttgctatggttacagggcctggaccttcctccggaaggtgagaaacaggagcgcagctcagctgggctggaactgccctcctggaactcccccagcctacaacctaggaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcc

SEQ ID NO: 135498 - DNA, 577 bp, Homo sapiens
  Payload ID: 6493
  Gene Symbol: FKRP
  Gene Name: fukutin related protein
  ENST ID: ENST00000593902
  CDS Start-End: 167-577
tgtttgttttgagacagggtctcacccaggctagagtgaagtggagcaatctcggctcactgcaacctccgcctcctgagttcaagtgattctcacacctcagcctccccaatagctgggattacaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggca

SEQ ID NO: 135499 - DNA, 583 bp, Homo sapiens
  Payload ID: 6493
  Gene Symbol: FKRP
  Gene Name: fukutin related protein
  ENST ID: ENST00000595570
  CDS Start-End: 400-583
ggccattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaagggtctcacccaggctagagtgaagtggagcaatctcggctcactgcaacctccgcctcctgagttcaagtgattctcacacctcagcctccccaatagctgggattacaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacg

SEQ ID NO: 135500 - DNA, 592 bp, Homo sapiens
  Payload ID: 6493
  Gene Symbol: FKRP
  Gene Name: fukutin related protein
  ENST ID: ENST00000598271
  CDS Start-End: 506-592
cattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgtaagttgcatggcttttgtccgtcttttttttgtttgtttgtttgttttgagacagggtctcacccaggctagagtgaagtggagcaatctcggctcactgcaacctccgcctcctgagttcaagtgattctcacacctcagcctccccaatagctgggattacaggatgccccggaggcccagctagccccagacttcggccccatgcggctcacccgctgccaggctgccctggcggccgccatcaccctcaaccttctggtcctcttctatgtctcgtggctgcagcac

SEQ ID NO: 135501 - DNA, 591 bp, Homo sapiens
  Payload ID: 6493
  Gene Symbol: FKRP
  Gene Name: fukutin related protein
  ENST ID: ENST00000593800
  CDS Start-End: 289-591
attgctccaagatggcggcggcggcggcagcggtaaagacggggtttctccatgttggtcacgctggtcttgaactcccgacctcaggtgatctgcctcaggcccgcctcggcctcccaaagtgctgggattacaggtgtgagccatcacgcccggccaggggatgttttaagaatgtctctcagaggagcgcagctcagctgggctggaactgccctcctggaactcccccagcctacaacctaggaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctg

SEQ ID NO: 135502 - DNA, 556 bp, Homo sapiens
  Payload ID: 6493
  Gene Symbol: FKRP
  Gene Name: fukutin related protein
  ENST ID: ENST00000595868
  CDS Start-End: 347-556
attgctccaagatggcggcggcggcggcagcggaggagatgctctgctgaggggcagttgctatggttacagggcctggaccttcctccggaaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttc

SEQ ID NO: 135503 - DNA, 545 bp, Homo sapiens
  Payload ID: 6493
  Gene Symbol: FKRP
  Gene Name: fukutin related protein
  ENST ID: ENST00000594467
  CDS Start-End: 441-545
attgctccaagatggcggcggcggcggcagcgggagcgcagctcagctgggctggaactgccctcctggaactcccccagcctacaacctaggagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtgg

SEQ ID NO: 135504 - DNA, 584 bp, Homo sapiens
  Payload ID: 6493
  Gene Symbol: FKRP
  Gene Name: fukutin related protein
  ENST ID: ENST00000597313
  CDS Start-End: 406-584
cattgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgttggtctcgaactcctggactcaagtgatcctcctgccttggcctcccaaattgctgggatcacaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttga

SEQ ID NO: 135505 - DNA, 569 bp, Homo sapiens
  Payload ID: 6493
  Gene Symbol: FKRP
  Gene Name: fukutin related protein
  ENST ID: ENST00000602250
  CDS Start-End: 410-569
attgctccaagatggcggcggcggcggcagcggaggagatgctctgctgaggggcagttgctatggttacagggcctggaccttcctccggaaggtgagaaacaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgc

SEQ ID NO: 135506 - DNA, 633 bp, Homo sapiens
  Payload ID: 6493
  Gene Symbol: FKRP
  Gene Name: fukutin related protein
  ENST ID: ENST00000593877
  CDS Start-End: 621-633
ctcccaaagtgctgggattacaggtgtgagccatcacgcccggccaggggatgttttaagaatgtctctcagaggtagagtgtgtctatggaaggggttgtcatggtaacagcttctgttggcttctagccctaccttttctggacacattcatgctagagggatggttataggttgctataataactgacatccctcccattcaccccaccccactcctgagacaccccaggtggtgcccgagattataggacttcaagagaaaggattccctgacctttctcttgccacttttgtggataagatgaaattgtgctctattgtacggaaatggctgatttgggattttctggttctcctcctctcaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcaccc

SEQ ID NO: 135507 - DNA, 482 bp, Homo sapiens
  Payload ID: 6493
  Gene Symbol: FKRP
  Gene Name: fukutin related protein
  ENST ID: ENST00000602181
  CDS Start-End: 196-482
attgctccaagatggcggcggcggcggcagcggaggagatgctctgctgaggggcagttgctatggttacagggcctggaccttcctccggaaggagcgcagctcagctgggctggaactgccctcctggaactcccccagcctacaacctaggaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcat

SEQ ID NO: 135508 - DNA, 1797 bp, Homo sapiens
  Payload ID: 6494
  Gene Symbol: FH
  Gene Name: fumarate hydratase
  Uniprot ID: P07954
  ENST ID: ENST00000366560
  CDS Start-End: 40-1572
acagccgcccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaa

SEQ ID NO: 135509 - DNA, 1471 bp, Homo sapiens
  Payload ID: 6495
  Gene Symbol: FAH
  Gene Name: fumarylacetoacetate hydrolase (fumarylacetoacetase)
  Uniprot ID: P16930
  ENST ID: ENST00000261755
  CDS Start-End: 78-1337
ggaagggcgggcgagactgtggaggacctggagctggcgggggtcagggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcact

SEQ ID NO: 135510 - DNA, 2152 bp, Homo sapiens
  Payload ID: 6495
  Gene Symbol: FAH
  Gene Name: fumarylacetoacetate hydrolase (fumarylacetoacetase)
  Uniprot ID: P16930
  ENST ID: ENST00000407106
  CDS Start-End: 156-1415
cggggcggggctctggaagggcgggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtgggattttcttattagacatcccaggcctcctggtattccatggaatttgaaaagagactggcacctgtagtagtcagggctctccagagaaatagaaccaaggagaaagagatcgatttattgattgattgattgattttaagcaaattggcttctgggattctggagggtggcaagcccaaaacctgctgggtgggttgctggctggagacccaaggaagagctgcagtttgagtctgaagcagtctgctgtcaaaatttcctcttcctctgggaagtgagtcattgtttggtgaaggccatcaactgattagatgaggcccagccacactgtgggggtcttctgctttactccactgatttaagttttatttcacctaaaaagtactttcttagaaacatgtagaatagcatttgagcaaatatttgggtaccttagtctagccaaattaatacagaaaactgcccatcaca

SEQ ID NO: 135511 - DNA, 568 bp, Homo sapiens
  Payload ID: 6495
  Gene Symbol: FAH
  Gene Name: fumarylacetoacetate hydrolase (fumarylacetoacetase)
  ENST ID: ENST00000558022
  CDS Start-End: 86-568
aggggaggggcggggctcggggagtgaggcaagactggagggcctgggactctcgggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggc

SEQ ID NO: 135512 - DNA, 1549 bp, Homo sapiens
  Payload ID: 6495
  Gene Symbol: FAH
  Gene Name: fumarylacetoacetate hydrolase (fumarylacetoacetase)
  Uniprot ID: P16930
  ENST ID: ENST00000561421
  CDS Start-End: 159-1418
aaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgc

SEQ ID NO: 135513 - DNA, 3427 bp, Homo sapiens
  Payload ID: 6495
  Gene Symbol: FAH
  Gene Name: fumarylacetoacetate hydrolase (fumarylacetoacetase)
  Uniprot ID: P16930
  ENST ID: ENST00000539156
  CDS Start-End: 2239-3288
gaacatgaaagtggacaaggagcgtgaccattgaagcacagcaccacagggaggggtttaggcctccagatgactgcgggcaggcctggataatatccagcctcctacaggaagctggtggagcagagtgttccctgactcctccaaggaaagggagactcccttttgcggtctgctaagtaatgggtgccttcccaggcactggcgttaccgcttgaccaaggagcgctcaagcggcccttatgcgggtgtgacagggctcacctcttgccttctaggtcacttctcagaatgtcccttcagtacctgaccctatacccaccggttattcctaggttatattgtactacaataaagagtaatattaaaaactaatgattaataatgtttatactaataatcgataattgtccatgatcatctgtatatctaatttgtattacaactgtatagcagtatagctacagtttatgccttcagtctcttgcctcggcacctgggtaatccttcgcccacaccaatcccatgcttccccctctatgtcaggctgggagttgggtaatgctttcctttggacaactttatatcagatatgaccaactattttaaaacaaaggcaatgcacattcattctcttgaagttagacaaatgcggtctccctccttagtttgtttccctcaagttgcagatgggaaactgaggcccagagacttgtccaaggtgataagatggtgaatgagggagcagacttggagcccaggaatcctggatctgacctgtgagccccctctagttttgtgctgaagaaaataactcccaaggttgaaagtagagggactcactctctcagactttttctgggtcctcaggtcatagtttgaagcacaagtttgaagcttctaggctttgtttgcatttgaggcagcaggcagctgcacttgtgaccccattttggaagttgcttactggtggtgactccttcttgccttcagctggggtgtggggaccagggtcagagatgtggtccaagggtctgccctgcacattccctgaatggaaagccacttggattcaggtggttcagctctttgcctaaagcagatttgccattttcaggaggggaagactgaggcccagggagttggcagtggggctgagaatgagtaactaagctctccaggcagcctcttctagggtaggctctgctgggacctcagatgaggagtatggctctggtctaccccgattccaagagctgacatgcgtggagaaatggtcatcttttctcagcccaccccagtgagcagccaatggagataaggccagccaataatcccaccactaagctcgctggcactgaaatggccaagctggtggttcaggagagctggaagcctggctcaggacagagccctgggaagttgagtctgcaaacatgccctcgggttcttgttgacgagcaaagctcagggttgtggggacaaagaccaggacttaacaaatatttaagacatctttgttgatgctgggattttgtggtacagaaaggaacttgccttgcatgttctgagcagtctggcttcctgcagctcccttacaacccgagctctcctccatttgagctacaacagagctcattaatccaagccacctggccctcagcactgtgtgttgggcactcatgctccaccgcacaactgaactaccctagtcaaggcctagaaacctggaaaataatccaacatcctggtaaggtggtaagctcctcatcactggaggcatttatgtaatgcctagggaactttgcaggggtctttgcccaggttaagtggctaggaccaggctgactgctcttcccccagtccaagggatatttgatttctttcccattcagggaacacagattatttttccttttagttctggaagcagagatggcacaagggagctggggcaggatgctgagaacatggttcttcagtccgctctgcatacagggccacctaaagggggacctgtggactcttcaatagataggctttctgagtaaatgagccaagcccagccaggggctttttctggtgctgacggtgtcgtcttcctcctagccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgc

SEQ ID NO: 135514 - DNA, 324 bp, Homo sapiens
  Payload ID: 6495
  Gene Symbol: FAH
  Gene Name: fumarylacetoacetate hydrolase (fumarylacetoacetase)
  ENST ID: ENST00000561353
  CDS Start-End: 1-181
taacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggtgagtatctggctgcactgagggctgcccacgcagagcatccctgctccccacacagccccaagggccctcagctcagcctcgagaagagatttcaggcccgaggagccagaaaacttcggctccatgttggaactgtcgtggaagggaacgaagcccataga

SEQ ID NO: 135515 - DNA, 1964 bp, Homo sapiens
  Payload ID: 6496
  Gene Symbol: FAHD1
  Gene Name: fumarylacetoacetate hydrolase domain containing 1
  Uniprot ID: Q6P587
  ENST ID: ENST00000382666
  CDS Start-End: 264-1010
cacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccgggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctgagacagggtctcactctgtcgcccaagctggagtgcagcagtgctatcacagctcactgcagcctcgaactcccggggtcaagcaatcctccctcagcttcccgtttctgaggttacagcccaaagtctcctcagcaacacttcctgtgagactacaggaatgaagggtgcctgtgtgatcagtcagatcaatcagcacatggaaactgagaaagacagatttaaagtccaaggagtttttgttgcaagttgtgcacatgttagatgcttcatttacaatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaaaacagtaaaacacactttctacgcagccattctcaggagtcatctgaaactgcgtacaccagtcctctgcctgccctccttccctccctctgccaagccctcgaggtccatcccagtctcatttccttgctggggccctcccttctcgtatcccagcctgcagcctttctctcttggaacagcagcagagtgcacgcctcaggactgactggtgctgttgcatcagctccttattctcacctccctggctgggagttctgagggcaggaactgtgtcttgtgcctggaaagcacgagttcaacagctgctcactggatgggcctgcacggggccttctctacaaatacagaaagccttgcaaggctggccgggtagcacccagatgctattaacactgctggtgatacactctcctctctttcagtgatttatgctattccatatttctgaagcaagccttactttagcaattttaaacagggaaactaattcaaatttctcaaataggggaaatgaactgaagatagtggtttcttatctagccacagatcacttggtctagcaaattttagatgcttttcctcagatatcaataataaatgtacaggaaaaaaa

SEQ ID NO: 135516 - DNA, 1845 bp, Homo sapiens
  Payload ID: 6496
  Gene Symbol: FAHD1
  Gene Name: fumarylacetoacetate hydrolase domain containing 1
  Uniprot ID: Q6P587
  ENST ID: ENST00000382668
  CDS Start-End: 264-944
cacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccgggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctgcccaaagtctcctcagcaacacttcctgtgagactacaggaatgaagggtgcctgtgtgatcagtcagatcaatcagcacatggaaactgagaaagacagatttaaagtccaaggagtttttgttgcaagttgtgcacatgttagatgcttcatttacaatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaaaacagtaaaacacactttctacgcagccattctcaggagtcatctgaaactgcgtacaccagtcctctgcctgccctccttccctccctctgccaagccctcgaggtccatcccagtctcatttccttgctggggccctcccttctcgtatcccagcctgcagcctttctctcttggaacagcagcagagtgcacgcctcaggactgactggtgctgttgcatcagctccttattctcacctccctggctgggagttctgagggcaggaactgtgtcttgtgcctggaaagcacgagttcaacagctgctcactggatgggcctgcacggggccttctctacaaatacagaaagccttgcaaggctggccgggtagcacccagatgctattaacactgctggtgatacactctcctctctttcagtgatttatgctattccatatttctgaagcaagccttactttagcaattttaaacagggaaactaattcaaatttctcaaataggggaaatgaactgaagatagtggtttcttatctagccacagatcacttggtctagcaaattttagatgcttttcctcagatatcaataataaatgtacaggaaaaaaa

SEQ ID NO: 135517 - DNA, 1974 bp, Homo sapiens
  Payload ID: 6496
  Gene Symbol: FAHD1
  Gene Name: fumarylacetoacetate hydrolase domain containing 1
  Uniprot ID: Q6P587
  ENST ID: ENST00000427358
  CDS Start-End: 290-964
ttgttttgtccgcgagccccgactgccacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccgggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttctaagtgg

SEQ ID NO: 135518 - DNA, 757 bp, Homo sapiens
  Payload ID: 6496
  Gene Symbol: FAHD1
  Gene Name: fumarylacetoacetate hydrolase domain containing 1
  Uniprot ID: Q6P587
  ENST ID: ENST00000615972
  CDS Start-End: 11-757
ggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctgagacagggtctcactctgtcgcccaagctggagtgcagcagtgctatcacagctcactgcagcctcgaactcccggggtcaagcaatcctccctcagcttcccgtttctga

SEQ ID NO: 135519 - DNA, 4757 bp, Homo sapiens
  Payload ID: 6497
  Gene Symbol: FAHD2A
  Gene Name: fumarylacetoacetate hydrolase domain containing 2A
  Uniprot ID: Q96GK7
  ENST ID: ENST00000233379
  CDS Start-End: 154-1098
ccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcagcagctttgcttctgctgtttgtcttcttttgggctttgtttcatgggacaagttggggcattttgtgggactggggaagaagagagcaaatacacacacatatgccaaaaagatgctgctgggctggggaaaagacaattcgtgtcgtccccttgtttatcacatcaaagaagggaaaaagcaagagatggcaagggacaatcaagcctcaatgattatatttatagctaagggtttgcagcctcctctccatcttctggctctaggacacagctgtgttctggggctcagaagtctcagcacaggctccttctcacagttctagctacaagtgaactgccggatgaactgttctagtttttcctgattgtccaggctggcaaaagtaggggacaggtggagcctggggcctgcagggctcggcgtctgctgcagaacctgggccatggaagatgggccgtgagtgcactcaccacagggactgtgtccacatggcccaggggccaggcctgtcccccagaaacctgccttgagacctctgaccccttaggcctcagtgtttgagtgcaaatgctgcctcaaagcagccccaataccccacctagaaggatgagccagtgatttgggagaccaagaggcaggaaaccatcccaccttctccaacccatcaccacgtctattgctggaagacaccaagtaaatcccagggtcttaatgaggcaccatcaggccagccctgtggggtgatgggaacatagctgggtttccctgagccactctattggggtgggagcagggggacagaagatggtgacactggctcctctcacccctaggtctctgaaggtccagatagcactgatggcaagctttgggtctgcacactctggaaagaagagagaagtgaaggctctaggtagggaggacagggagacactgggcacaggcttctctcctcttgtttaaagaagcccagggagggatagatctccgactggacagaagactactctgcagcccgccttcctagagttgggttgtcactgtccggcagggggcagcagccaccagcaaacaccactgcctgcaggagcctgggctgactggttgggactcaccaaagatcccttcttcctgggcggtggcctgcaggaactggaacagctgttggagaggagaagaaaaagaagacatcaaaaagaaaatctagtgctgggtggatatagagtatgaagatgtggagctgggaaaacagaggatgtggtgggatggggaaggaaaggttgtggaaggcctgcaccccgtctcagttcctccactgcttcgtcccagattctgtttttgttttcctgaatcagacttagtctccctccattctcccgtcccctgtgtgcccccatcctggtcctgcctcactggacagcctctccgcggccttcctcctccctgctccagaattctacttggtgccccccaaccccactcgactcattgtccacctggcctctgaggccaggcaccctcattcccctctcccacccaccccacccaaggaagcccagcacagaccatctcatctcactccaccatcacttctttgccaaatgcatttccaaacaccctcatgagctttgctgatctctttgccatctctccctgccccactccgatggctcctcctgcctggtgaagactgccctgggtatcccagaactgaacctgcagcagccagcacagctgaccttggggcgataagcagccagggaaaggctttcttaaaaaaaaacaaaaaacaaaaccaataactcagtaagcagattaaacaaaggtagagacggagccctccacccctctcacacactcatcctcacacccagctataccacaccccacaaatgttgcttatgtttccttggtcattctgtccatcctcctgtctgtccaaagccaaggacactgctctactctaaattttttgtcccgaagcccccaaatactgcaaccctgacccaatgcacgaagccaccccaaaatacagcagaggacaccaggactttcattttccctcagtatggcccatcctttgggtatgccaactccatgtccaccaagcactgcatgtaggacagggcacagtttggaggccttggtccagccactgccccagacccaccttggctctctcctcactaacacccgagaagcccagacttcccagtgtttagcaacagattaaactctaagccaacaacaacagaacagggtggagtgagtggaaagcaaatgaaatgttaaaaaaaaaaaaaaagcaatacttgcattctcattagtaggaacatgtgagatgaagcatgttatgttattaggcattctcttgattcggtaaacacaagctgaataaatttataaatatcagcattaagcgagatttaacggggagctgtttatcttctgcctgtcaggcaggcggcaacactctccatgtatcactcgccagccgtgcagtcctcactctcttgcccaggtaagctggggaagagcctgctgccgcccagctctggttgtggaagggctggcaccaaggagctgcgagcttacctcaactcatctcacctcaccatgccggctgcgaggcggcccgtgcagtccgtgcgcaggaggtcacactcccatgctgcatcccagcccctccagaagcagagcatgacctgggtgactttgaggatgctatttaacctctctaagctaaagctcctcgactgcagcatcaacagatcagtgccgacctgttaaggccgtcgagagcatcaaatgctactgttcagcaggtgcctgacacatagtaggtccacaagcaaatgattttcctgcttgcatcatttctagcacagagctggaggaaatggcgaggtgcaggtggccgctgggccctgctgttctacatgggagcaagacagctgctaggtgaaggggaatgaccaggcagccacagggaggacatgtggcctcaggaagcctgggtgtgtatcctggttctgctaggaacacgtgtggggctttgtgtgggtgactctctggctccccaagcctccctttcctactgttatatccttaaagtgcctctgaggccaaagcctttgtggcaattgtcaaatgagtccatatgcagtgagtaccgtgttgagggaggacaaggtcaccaagagctgagaatgtttctccgactgatgagacctagatattgggtacatggaggtccccggtccctttgtgattcctgcagcctgttgcctccttgcctggaccccgcctcagctcagaaagccaattccctagattccaaaggccttcccagaccaattagcatgtcctgcagctgtcagctccctgtgcctagcctggacctcagctcatgtctagcacccagtctcccaaccccacacatattcacaaataaaagaaaataacaaatgacatgaattcttca

SEQ ID NO: 135520 - DNA, 715 bp, Homo sapiens
  Payload ID: 6497
  Gene Symbol: FAHD2A
  Gene Name: fumarylacetoacetate hydrolase domain containing 2A
  ENST ID: ENST00000418606
  CDS Start-End: 335-715
gtgctcaggcgcccgccgcccttgaccttcggccccgcgagctctaaccctacagcgcaggaagatcggccgccgcggccaggtaggacgagcctggctgggtctaggccagaagggtgtccgtggcgccggtctcccgcggagcgcagaactagtaccggatccccagccgcttctgaccacacagacggggcggacctgtcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgccc

SEQ ID NO: 135521 - DNA, 522 bp, Homo sapiens
  Payload ID: 6497
  Gene Symbol: FAHD2A
  Gene Name: fumarylacetoacetate hydrolase domain containing 2A
  ENST ID: ENST00000445649
  CDS Start-End: 279-522
gtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggtaggacgagcctggctgggtctaggccagaagggtgtccgtggcgccggtctcccgcggagcgcagaactagtaccggatccccagccgcttctgaccacacagacggggcggacctgtgctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaa

SEQ ID NO: 135522 - DNA, 1366 bp, Homo sapiens
  Payload ID: 6497
  Gene Symbol: FAHD2A
  Gene Name: fumarylacetoacetate hydrolase domain containing 2A
  Uniprot ID: Q96GK7
  ENST ID: ENST00000447036
  CDS Start-End: 283-1227
gatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacaga

SEQ ID NO: 135523 - DNA, 1305 bp, Homo sapiens
  Payload ID: 6498
  Gene Symbol: FAHD2B
  Gene Name: fumarylacetoacetate hydrolase domain containing 2B
  Uniprot ID: Q6P2I3
  ENST ID: ENST00000272610
  CDS Start-End: 189-1133
acaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaagcagca

SEQ ID NO: 135524 - DNA, 1388 bp, Homo sapiens
  Payload ID: 6498
  Gene Symbol: FAHD2B
  Gene Name: fumarylacetoacetate hydrolase domain containing 2B
  Uniprot ID: Q6P2I3
  ENST ID: ENST00000414820
  CDS Start-End: 272-1216
gtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaagcagca

SEQ ID NO: 135525 - DNA, 1196 bp, Homo sapiens
  Payload ID: 6499
  Gene Symbol: FUNDC1
  Gene Name: FUN14 domain containing 1
  Uniprot ID: Q8IVP5
  ENST ID: ENST00000378045
  CDS Start-End: 170-637
agaaggtcctgcgctgagagaagggggcggagacaggactacgcgcctggagtaggagaaggaggaaaaaagagaccatagacttccatcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagactctgctgatgtaatatga

SEQ ID NO: 135526 - DNA, 6455 bp, Homo sapiens
  Payload ID: 6500
  Gene Symbol: FUNDC2
  Gene Name: FUN14 domain containing 2
  Uniprot ID: Q9BWH2
  ENST ID: ENST00000369498
  CDS Start-End: 255-824
tgagcgagcgagccccgacggccgcggtgggtggaggggggaaagtgggggagagtggggcgggagtagagggagagcgagggagggagcctcacccccgggacgctttctgcgcacgcgcatctcggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccagggattcagaattaagaaagatagtgataggacatgagaaataaatttccatcaagtgtaatctaccgtctcatgatgaccacaaccctgagaattattctttaaaagcttacacacacacacacacacgggcacacacgcacacacagaatcttaccacattttgctgtagtggcatgttaccatgtctacagtccctactagaatatcagtcagctttcagagggcaagacttctgtcttcaccattatactcacagggcctagcacttaataggtgctgagtatttgaataatgactttatagaaagaaaactcactattaaaggttagttttactcagaattgttaatcttggagatgatctcttgtgaaatatgagtgtgtttctaaggccatacatttaaaaatgtttgcattttaacccgtcttgagaatgatgtattgaatttgaaaatcaaaactaccagtggatgtgtggaactttacagaaaccacctatttgcgtttttctccttacatttaaggaaacataagccattttgcttgcaatatgtatgaatcatctcaaaaccataatggtatgagcctctttgctgcatattttgctataagaacttattttttttcactttttattatggacgctttcaggaatatataaaagtagagaatatagtacaataatccccctgtgtatctatcactcactcacaacaatcatcaaattatagctctgctggtttttaccagttattgtgaaacaaatatcaaaatgtcattttatcatatttcagtatgtatctctaaaaggtaagaattatttctaaaaatcataaatacctcatcatatcagacattaacagtaattacataatatccaaaatctgatcagtgttcaaaatttcctcaagtgttttatatttagtttgtttgaatcaaaattcatgcaaggttcacatcgtatttgcatgatttggataagtctcttaaccttatagatcctcctctatttttttttttttgcttgctatatatttatatctctatatatattgatatagacatatgtagtgacactgagtcatctgtttcctgcttccccacactctgcctctcctgacatctgggtctctgggttatgccatatatggtgatagtggctgcagccactttacctgtgtgacttacccacagcaatgggatggtaacagcaaagctaaccaaagtgctctgtgcccctttgggttgcatgtggggagactggccacccaatgcctctccagtggggtaggggttgtcttttggtgcatctgtttttcctgtgattattggtgagggcagcaaagattagcaggtggttgtaaactaccttgagtaggttgtaataaatagtctggcctcagactgtattctgattgtctgaattaagatctgtaggtaggtccctcctgaagttttttcccagctggctgcctctacgactgtgagggtcatggttgaggtcagtattgcaggttggcctcatcctgctagtatgagaacggctgtgagttctgcccacggtgtgaggccactgtgaccacttgggattgtgcagagctggcatggaggttgaacacgcacagctgcacaccttgttttcagtttagctgaaccatcggtgaaggaggctcaggcatttggggttacctgtgaatcaaggccctattgtgccagcagttttgtttcaggtggtgaagtgggagttaaggtttcccccaaaagaacagctgccactcctccatgcaaaaccgagatgattcaaggaccaggcagctccacctttcagtgcactactttcatttgactggagaggcctgcttagctaggcacgtattttctccagtagcagagtccaatgacgctctggacttcctaattagtggtggtggggcggaagtttttccttgggaagagcgttgtcgctgtatatggtccgcagaaacttgacttggaatgtgttcggggtttcatcgcccccttgtggcggcgacgtggtaacaccgcactcaaggcttccaacttgtcaaccaataggatggcatctacgtagtgaaggcttcccttcccttgtcctgcagcgtgctggacagtgtcccggctcagggaccccttctgtccccttcctggctactatgggtcggccctgcgtcctcaccactttgagccaccctttgacccagcgtctctcccgcaatgggacctggtgggatggggacttggagcatgctacaggagaggtagaacttttgagtctcttcttcccaaggttctccccagagtcggagagcagagacggatccaggggcactttctggccgctgcctgctcgggctcaacagatggagtccaatgtttcagtctcccccaagaatgtgtatcctcattgctgacacgggagctgggtgcggggagagatgtggtggtggggacccttgcctgagcagcccattgtcatgagtgttattgccattgtgataatatgttagcatgactctcctcccaaatggccgcttgtttgttgcaatctcccgccactcagcctccagacattcattaacaggacagtggggttcttgactcccctaccactggggtgacagtccttgctactggatctgggcagttactgtctcatggatgctggcagaagacgattcaagttggcggactagattctacaaggaatgatctcttgcataattctagccaacatgctcttggggtgggtgcttctggttttggaaagcaaagttactgtgtagttaacaactattgtggtaagaatagtctctccatcattcttttgtttcacggttgtcagaaagatgggcataactaatggttgggctcttatttggaacctctacttttgtacagtttgggaatctctgcttgaaaagatggtatactgatggatttgaaatttctgagtatcatcaatgtttcatgatgatctcaatttcttctcagagggaagctcacagccagttttggaccccagagaaaaatgtggctgctgccctctactccctctaccaaattatcagcttcatttctttgtcatgaaatctagtatgatttctcagaaatcaggcccagaactaaaatacattttctgcccaattttctaagaggtcacactaacatctgagtaattgggcagaaaacctattttagttctgagcctgatttttctagaagtcatatggtatagcttatatttccgatgcttgcattctttttaaggggtcatgaatcttaatacttttttttttaaaagaaaagtgtcgcactttttcacatttttataaagctttaaagtcagtttactgacttttcaaaagtgtctacctttttaaattttaaaatggtaagaaatgacattcctgagagcagtggctttcatccttgcttgcacttgggaatcacctgtgaaattttaaaaactactaatgcctggctctcatcctagagattctgatttcactggtctggagtgctgttcaggcatcctgaggttttaaagtgtcttagctttttctaatgagcagcagagactgagaaccactgaagtacacagttggaagctggtgctgaaaaaattaagagttttgctgttaactccttaagagggctttaaagccttttatattaagtgccatacaacttcagatgccttctgaatactgaacacaagtgtaatattatagttcattaaatgtcttaggaatcgtgtggagtgaatgcaaggaaaggagtgacaagatatcaccccacaaatgacttacccattacgaagggaaaactacctttctagctaaaaggtctgtcagtcactaaccaagtgattaaacttagcatcactaatagccaacttaacaaagtttttttttttttttggtttctaaaatgggagatcatagttttcaccttcctagagttctttgcttaagactgagattcagtgttactcttggtccctaacaataagaagcactcagtaaatgttaagccttctatgatggctattttatttttttgtatgtcataataatacctaagaataagaagagttaaattaatgtcttcaaatggatttgttgacttaaactgacacaatcctttaaaagaaggaactgatttgaacctttcaaaactgaaagaaagtcgtatactgatacagtttggagccaccgaatgtcatgttgaaccgtattccctaatggaggtggatcctggtgagaggtgattggatcgtgggggccatcccctcttggtacttcactcatgatagtgagttctcatgagatctggcacttcacccctcactctctcttgctcctgctttggccatgtggagtgctcactccccttttgctttctgccatggctgtaagtttcctgaggcgtccccagaagcccatcagataccagtgccatgcttcctgtacagcccatggaactgtgagccaactaaacctcttttatttataaattaccgagtctcaggcactttttatagcaatgcaacaatggactaatacatatactttagcataaaaacatttaaaagagtctgaaactggagtagttaactcagtaaaaataacttggcaataaaacacagaaaaacaatctatttgatcatgtagtgattcctaatgtaaatcctagtacaactgtcaactgataattttaaatgtaatttagatttgtagatggtgtaacattaaagttgtatgatgtt

SEQ ID NO: 135527 - DNA, 871 bp, Homo sapiens
  Payload ID: 6500
  Gene Symbol: FUNDC2
  Gene Name: FUN14 domain containing 2
  ENST ID: ENST00000456179
  CDS Start-End: 1-285
tcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagttggcaaccctcacttttgcaagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatg

SEQ ID NO: 135528 - DNA, 4244 bp, Homo sapiens
  Payload ID: 6501
  Gene Symbol: FURIN
  Gene Name: furin (paired basic amino acid cleaving enzyme)
  Uniprot ID: P09958
  ENST ID: ENST00000268171
  CDS Start-End: 280-2664
agaactggaagggccccgccctgtgaagggataggagcctgactgttgcagctgcagtgagtggcggggaagcagcagcggccaggatgaatcccaggtgctctggagctggatggtgaaggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccagggttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatgctgggttggtgcacagtgatttttttcttgtaatttaaacaggcccagcattgctggttctatttaatggacatgagataatgttagaggttttaaagtgattaaacgtgcagactatgcaaaccagg

SEQ ID NO: 135529 - DNA, 587 bp, Homo sapiens
  Payload ID: 6501
  Gene Symbol: FURIN
  Gene Name: furin (paired basic amino acid cleaving enzyme)
  ENST ID: ENST00000559353
  CDS Start-End: 381-587
aaacagcagtcggtcctggggtgaggcgcaatttgagtggcccagagtggctctctgtgtcaggaggttctggtgctggagaaaagggctttgcccaagaacacagccaggaagagcacccacagctctctctggccacagcctggaacagagtcccatgtgaaacaagaccatgagaaatacagcaagcctccaggtttgagacaaactgggactagaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcat

SEQ ID NO: 135530 - DNA, 580 bp, Homo sapiens
  Payload ID: 6501
  Gene Symbol: FURIN
  Gene Name: furin (paired basic amino acid cleaving enzyme)
  ENST ID: ENST00000560824
  CDS Start-End: 54-580
gtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaatggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgacca

SEQ ID NO: 135531 - DNA, 844 bp, Homo sapiens
  Payload ID: 6501
  Gene Symbol: FURIN
  Gene Name: furin (paired basic amino acid cleaving enzyme)
  ENST ID: ENST00000558794
  CDS Start-End: 1-651
cccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaagtgagggctggacccaggctgggagggggccagtgggacctgagagtcgcagggggtgcccgctggtccctctgggccaggctgaccatcatggtgctctcctgcacagagacatcgggaaacggctcgaggccacatgactactccgcagatgggtttaatgactgggccttcatgacaactcattcctgggatga

SEQ ID NO: 135532 - DNA, 4345 bp, Homo sapiens
  Payload ID: 6501
  Gene Symbol: FURIN
  Gene Name: furin (paired basic amino acid cleaving enzyme)
  Uniprot ID: P09958
  ENST ID: ENST00000618099
  CDS Start-End: 381-2765
aaacagcagtcggtcctggggtgaggcgcaatttgagtggcccagagtggctctctgtgtcaggaggttctggtgctggagaaaagggctttgcccaagaacacagccaggaagagcacccacagctctctctggccacagcctggaacagagtcccatgtgaaacaagaccatgagaaatacagcaagcctccaggtttgagacaaactgggactagaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccagggttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatgctgggttggtgcacagtgatttttttcttgtaatttaaacaggcccagcattgctggttctatttaatggacatgagataatgttagaggttttaaagtgattaaacgtgcagactatgcaaaccagg

SEQ ID NO: 135533 - DNA, 4191 bp, Homo sapiens
  Payload ID: 6501
  Gene Symbol: FURIN
  Gene Name: furin (paired basic amino acid cleaving enzyme)
  Uniprot ID: P09958
  ENST ID: ENST00000610579
  CDS Start-End: 227-2611
cggccgaggggcgcccgagccgccgcggcggtcgcctggaaaagtttccccgccagggctccccaggggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccagatcttcggggactattaccacttctggcatcgaggagtgacgaagcggtccctgtcgcctcaccgcccgcggcacagccggctgcagagggagcctcaagtacagtggctggaacagcaggtggcaaagcgacggactaaacgggacgtgtaccaggagcccacagaccccaagtttcctcagcagtggtacctgtctggtgtcactcagcgggacctgaatgtgaaggcggcctgggcgcagggctacacagggcacggcattgtggtctccattctggacgatggcatcgagaagaaccacccggacttggcaggcaattatgatcctggggccagttttgatgtcaatgaccaggaccctgacccccagcctcggtacacacagatgaatgacaacaggcacggcacacggtgtgcgggggaagtggctgcggtggccaacaacggtgtctgtggtgtaggtgtggcctacaacgcccgcattggaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgacgactgacttgcggcagaagtgcacggagtctcacacgggcacctcagcctctgcccccttagcagccggcatcattgctctcaccctggaggccaataagaacctcacatggcgggacatgcaacacctggtggtacagacctcgaagccagcccacctcaatgccaacgactgggccaccaatggtgtgggccggaaagtgagccactcatatggctacgggcttttggacgcaggcgccatggtggccctggcccagaattggaccacagtggccccccagcggaagtgcatcatcgacatcctcaccgagcccaaagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggccacatgactactccgcagatgggtttaatgactgggccttcatgacaactcattcctgggatgaggatccctctggcgagtgggtcctagagattgaaaacaccagcgaagccaacaactatgggacgctgaccaagttcaccctcgtactctatggcaccgcccctgaggggctgcccgtacctccagaaagcagtggctgcaagaccctcacgtccagtcaggcctgtgtggtgtgcgaggaaggcttctccctgcaccagaagagctgtgtccagcactgccctccagggttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatgctgggttggtgcacagtgatttttttcttgtaatttaaacaggcccagcattgctggttctatttaatggacatgagataatgttagaggttttaaagtgattaaacgtgcagactatgcaaaccagg

SEQ ID NO: 135534 - DNA, 650 bp, Homo sapiens
  Payload ID: 6502
  Gene Symbol: FRY
  Gene Name: furry homolog (Drosophila)
  ENST ID: ENST00000380217
  CDS Start-End: 20-607
catgcttgctgtgtagcaaatggaatctcttgcacaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctg

SEQ ID NO: 135535 - DNA, 10688 bp, Homo sapiens
  Payload ID: 6502
  Gene Symbol: FRY
  Gene Name: furry homolog (Drosophila)
  ENST ID: ENST00000380250
  CDS Start-End: 497-9535
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcaggtaagccagcgattccccacaacacaccccaacgggcgccagatcatgcttacctacctgctgccctggctgcacaacatcgagctggtggacagcaggctcctcctcccgggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagact

SEQ ID NO: 135536 - DNA, 691 bp, Homo sapiens
  Payload ID: 6502
  Gene Symbol: FRY
  Gene Name: furry homolog (Drosophila)
  ENST ID: ENST00000436046
  CDS Start-End: 240-691
tggtatgaacagtctgccctggacggaaggcctgttttagtttgtcttctactgtaggtctttagcacctgactaaaaatacacctggggccaaaaatataagggccctgcattgtggctgagacacttatggtggcagtgagcaacaggaccatggagcccatcattatgtgttttggctttggaacatggtctgtgtagctgttccagactgttagtttgggtttcttttcaggctcatggagattacaactgcttgttggagacgatcctgtgtgatcagcttcataaaagggcttgcttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaa

SEQ ID NO: 135537 - DNA, 711 bp, Homo sapiens
  Payload ID: 6502
  Gene Symbol: FRY
  Gene Name: furry homolog (Drosophila)
  ENST ID: ENST00000477712
  CDS Start-End: 1-399
gaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattgg

SEQ ID NO: 135538 - DNA, 13200 bp, Homo sapiens
  Payload ID: 6502
  Gene Symbol: FRY
  Gene Name: furry homolog (Drosophila)
  Uniprot ID: Q5TBA9
  ENST ID: ENST00000542859
  CDS Start-End: 497-9538
agggggcggcgctcccggcccatcccttagccccgcggcggccgtgtgggccggaggctgcctgcaccgcgtcagggaggccggcctagaaaccctccctcccagaagaaagccgatcccagttcaggtggggtcttcctcggttgcgtacctggctggagccgagctggtgggcggccggcagccggcgtttctggtgatgacagccccgaaatgaaagcagcgcggccgccgcctccgagggctgcagggagatcagcgtccagcaaataagaagcaagtcctggacccggaggaggaggagcggccgagcatctctctctgctccgccgtgtcctttagatgagcactcccggccggagccggaggtggatccgcagagctgcctctgggcgcctgaccccgcgctgacatcacaacctgtgacaggcgcatcacgcccggtacctgctcccggccgctgcccgtcctcccagcctctttgtatgccgcagacatggccagccagcaggattcgggcttctttgagatcagtatcaaatatttactgaaatcctggagtaatacttctcccgttggcaacggttacatcaagcctccggttccacctgcttctggcacgcacagggagaaagggccgccaaccatgctacccatcaatgtggacccagacagtaaaccaggagaatatgtcctcaaaagtttatttgtcaacttcaccactcaggctgaacgcaagattcgtatcattatggcagagcccctggaaaagccattgacaaaatctctgcaacgtggagaagacccccaatttgatcaggtcatcagctcaatgagctccctttctgagtactgcctgccttccattctacgtacattatttgactggtataaaaggcaaaatggcattgaggatgaatcacatgaatacagaccaagaacaagcaataaatcaaaaagcgatgaacaacagcgagattatttaatggaaagacgggacctcgccattgattttattttttctttagtattaatagaagttttgaaacagattccacttcatcctgtaatagacagtttaatacatgatgttattaacttggctttcaagcactttaaatacaaagaagggtaccttggtcccaacactggcaatatgcatattgtggcagacctgtatgcagaagtcattggagtgttggcacaagccaaattccctgctgtaaagaagaaatttatggcggagctaaaagaattacggcacaaagagcagaacccatatgtggttcaaagcattatcagcttaataatgggcatgaaattctttcgaattaagatgtatccagtggaggattttgaggcctctcttcagtttatgcaggaatgtgcacattacttcctcgaggtcaaagacaaagatatcaagcatgccttggctgggctttttgttgaaatacttgttccagttgctgctgctgttaaaaatgaagtaaatgttccctgccttagaaattttgtggaaagcctgtatgacaccacgctggaactttcttctcgaaagaagcattccttggccttgtaccccctggtgacctgtttgctctgtgtcagtcagaagcagctgttcctgaacaggtggcacattttcctcaacaactgcttgtccaaccttaaaaacaaagatcccaagatggctcgagttgcactggaatctctctacagattactttgggtttacatgattcgaattaaatgtgaaagcaacacagctactcagagccgacttataaccatcatcacaacacttttccccaaagggtcccgcggtgtggtaccaagggacatgcctctgaacatctttgtgaaaatcatccagttcattgcccaggaacgtttagattttgcaatgaaagaaatcattttcgattttctttgtgtgggaaaaccagcaaaagcattcagtctcaacccagagagaatgaacattggtttacgggcattcttggtcatagctgatagcttgcagcagaaagatggggaacctcccatgccggttacaggagccgttcttccttcaggaaacacgttaagagtaaagaaaacatatttgagtaaaacactaactgaagaggaagccaaaatgataggcatgtccttatattactctcaagtacgaaaagctgtagacaacattttaaggcaccttgataaagaagtaggaaggtgtatgatgctgactaatgtacagatgttaaacaaagaaccggaagacatgatcacgggtgagagaaagccaaaaatagatcttttcaggacctgtgttgctgctattcctcgactgcttcctgatgggatgtcaaaacttgaacttattgacttactggctaggctctctattcatatggatgatgaattgcgacatattgcacaaaattctcttcagggtttacttgttgacttctcagattggagggaagatgtactatttggctttaccaacttcctgctccgggaagtaaatgatatgcatcacacactccttgattcgtccctgaagttgctgctgcagctgctcacccagtggaaactagtcatccagacacaaggaaaagtctatgaacaagccaacaaaatcagaaattcagagctcatcgcaaatggctccagtcacagaattcagtcggaacgaggtccccactgcagtgtactccacgctgtagaaggttttgctctggttttactctgcagtttccaggtggccacacgcaaactgtccgttttaatactcaaggaaattcgagcgttgtttattgccctggggcagcctgaggatgacgacaggccgatgattgatgtcatggatcagctaagttcttccattctagaaagttttattcatgtagcagtttcggattcagcaacattaccactcacccacaatgtggatctgcagtggttggtggaatggaacgcagtcctggtcaatagccattatgatgtgaaaagcccttcccatgtctggatatttgcacagtctgtcaaagacccctgggtcctctgcctcttcagcttcctccggcaggagaacttacccaagcactgccccacagccctcagctatgcctggccttatgccttcactcggctccagtcggtgatgcctctggtggacccaaatagcccaattaatgccaagaaaaccagcactgccggcagcggagacaactatgttactttgtggagaaattacctaattctttgttttggagttgcaaaacccagtattatgagcccaggacacttaagagcttccactccagaaataatggcgaccacacctgatggtacagtgagctacgataacaaggccataggcaccccatcggtgggagttctgttaaagcagttggtgcctttgatgagactagagagcattgagatcacagagtccttagttttaggatttggaagaacaaattcccttgttttcagagaattggtagaagaacttcatccattaatgaaagaagctctggaaagaagaccagagaacaagaaacgccgagaacggcgagacttgttaaggctacaactacttcgaatttttgaacttttggctgatgctggtgtaataagtgacagcacaaatggagccctagagcgggatactttagccctgggagctttgttcttagaatatgtggacttgacccgcatgctcctagaagctgaaaatgacaaagaagttgaaattcttaaagatatccgggcacattttagtgcaatggtggccaacttgattcagtgtgttccagttcaccaccgaagatttctcttcccccagcaaagtctgaggcaccaccttttcatcttattcagccagtgggcaggacccttcagcattatgttcactcctctggatcgttacagtgacagaaatcatcagattacaagatatcagtattgtgcattaaaagcaatgtcagcagtactgtgctgtggccctgtctttgacaatgtgggcctttccccagatggctacctatataaatggcttgacaacattctggcttgtcaagatttacgagttcatcaacttggctgcgaagttgttgtcttgctactggaacttaatcctgaccaaataaatctttttaactgggcaattgaccgatgctacacaggttcctaccaacttgcatctggctgcttcaaagccatagcaactgtgtgtggaagcaggaactatcccttcgacatagtgacattgttaaaccttgttctattcaaggcctctgacaccaacagagagatttatgaaatctccatgcagctcatgcagatccttgaagcaaagctttttgtatactcaaagaaagtcgctgagcaaagaccgggaagtattctctatggaacacacggcccgctgccacccctctacagcgtgtcacttgccctcttgtcatgtgagctggccaggatgtaccctgagctcacactccccctcttctcagaggtaagccagcgattccccacaacacaccccaacgggcgccagatcatgcttacctacctgctgccctggctgcacaacatcgagctggtggacagcaggctcctcctcccggggtcgagccccagcagcccagaggacgaagtcaaggaccgggaaggtgacgtgactgcttctcacgggctgagaggaaatggctggggctctccagaagccacgtcactggtcctgaacaacctcatgtacatgacggccaagtatggagatgaagttcctgggccagaaatggaaaatgcttggaatgctttagccaacaatgagaaatggagcaacaacctgaggatcaccttgcagttcctgattagcctctgtggggtcagcagcgacacagttctcctaccctatattaaaaaagtggcaatatacttgtgccgtaacaacaccattcaaaccatggaagagcttctctttgagctgcagcagacagagcccgtgaaccccatcgtccagcattgtgacaacccgcccttctaccgcttcacggccagtagcaaggcttccgcagcagcctcaggaaccacctctagcagcaatacagtggttgctggccaggaaaatttcccagatgctgaggagaacaagatattgaaagaatctgatgaaaggtttagtaatgtcatcagagcccacactcgcctcgagtcaagatacagcaatagctctggaggatcctacgatgaagataaaaatgatccaatttctccctacacgggctggttgctgactattacagagaccaagcagccgcagcccttaccgatgccttgtactggaggatgctgggcccccctggttgactatctcccggagaccatcactccccgggggccactccacaggtgcaatattgctgtaatttttatgactgaaatggtggtggatcacagtgtacgagaagactgggcgcttcatctaccattattacttcatgctgtcttcttaggtttagaccactaccggcctgaagtctttgaacacagcaaaaaactgcttcttcacctcttgattgccctctcttgcaacagcaatttccattccattgcttccgtgctcctgcagacccgagagatgggtgaagctaagactctaaccgtgcagccagcctaccaacctgaatatctctatacaggtggctttgacttcctgagagaggaccagtcatccccggtgcctgactcagggcttagttcaagctccacctcctctagcatcagtctgggaggcagcagtggaaacctcccacagatgacccaggaggtagaagatgtggacacagctgctgaaacagatgagaaggcaaacaagctcattgagtttctcacgaccagggcatttggtccactttggtgccatgaagacatcacacctaaaaatcaaaattcaaagagtgctgaacagctcactaattttctacgtcacgttgtatctgtatttaaagattccaaatcaggcttccatctggagcaccagttgagtgaagttgcattgcagacagccctcgcaagctcttcaaggcactatgctggtcggtccttccagatattccgggccctcaagcaacctctgtcagcacatgccttatctgaccttctctcaagattggtggaggtgataggagaacatggagatgagattcagggttatgtaatggaagcgctcctaaccttggaggcggctgtggataacttgtctgactgcttgaagaacagtgacctcctaactgtattgtcccgctcttcctcaccagatttaagctccagcagtaaactaacagcaagcagaaagagcacaggacaactaaacatgaacccgggaaccaccagcggcaacaccgcaactgccgaacggagccggcatcaacgaagcttctctgtgcccaagaagtttggtgtcatcgaccgatcctctgacccacctcgaagtgccacactggacagaattcaggcttgtacccaacaaggcctctcctcaaaaaccagaagctcatcctccttgaaggacagtctcacggacccatcccacataaaccatcccaccaacctgctggccaccatattctgggtcacagtggccttgatggagtctgattttgagtttgaatacttaatggccttaaggctgttgagcagactactggcacatatgccactcgataaggctgagaaccgagaaaagcttgagaaactccaggcacagctgaagtgggccgacttctccgggctgcagcagctgctgctgaaaggattcacatccctcaccaccacagacctgaccctgcagctcttcagtctgctgacaccagtgtccaaaatatccatggtggatgcatcccacgctattgggtttccactgaatgtcttgtgtctcctgcctcagctgattcagcattttgaaaatcccaatcagttctgtaaggatatagccgaaaggattgctcaggtttgtttagaagagaagaaccccaaactttcaaatcttgcacatgtcatgactctttataaaacgcacagctacacgagggactgtgccacgtgggtcaatgtggtctgtcgataccttcatgaagcatatgctgacattaccttgaatatggttacctacctggcagagctgctggagaagggcctccctagtgtgcagcagcccctgctccaggtgatctacagtcttctcagctacatggacctttctgtcgttcctgtcaaacagttcaatgtggaagttctgaagacaattgaaaaatatgtgcaaagtgttcactggagagaagctctgaatatcttgaagctggtagtttctcggtcagccagccttgttttaccttcataccagcacagtgacctctcaaaaatagaaatacatcgagtgtggactagtgcttccaaggaattacctgggaaaaccctggacttccacttcgatatttcggagactccaatcatcgggaggcggtatgatgagctgcagaattcttctgggcgtgatgggaagcccagggccatggccgtcacccggagcacatcttccacttcctcaggctccaactccaacgtccttgttccagtgagctggaaaaggccccagtattctcagaagagaacaaaagagaagttggtacatgtcctttctctgtgtggccaagaagtaggattgagcaaaaatccatcagtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagagacgaatcccatggagctgctcaccacagcctgtgactcgacccctgcagaacctcattcctttaacaccagaatgtccagctttgatgcttccttgcctgatatgaataatctgcagatttctgagggttcaaaggctgaagctgttcgtgaggaggaggacaccaccgtgcatgaggatgatctttctagttccatcaatgaactcccagcagcttttgaatgcagcgacagctttagcctggacatgactgagggggaagaaaaaggcaatcgggcactggaccagtttaccctggcgagctttggagaaggtgacaggggagtctctccccctccctcgcccttcttctcagccatccttgccgcctttcagcccgcagcctgtgacgatgccgaggaggcctggcgcagccacatcaaccagcttatgtgtgactcagatggctcctgtgctgtgtatacatttcatgtgttctcctccttgtttaagaatattcagaaaaggttctgcttcctaacctgtgatgcagccagttaccttggagataacctccggggaatcggatccaaatttgtcagctcttcccagatgctcacctcctgctctgaatgtcctacactttttgtggatgccgagactctcctttcatgtggacttctggacaagctcaagttcagtgtgttagaactgcaagaatatttggatacctacaacaacaggaaagaggccacactctcttggcttgcaaattgtaaggcaacatttgcagggggatcaagagatggagtaattacctgtcaaccaggggactccgaagaaaagcaattggaactgtgtcagagattatataagctacacttccagctgctattgctttttcagtcctactgtaagctcatcggccaggtgcacgaagttagctccatgccagagctgctgaatatgtccagggaactgagtgacctaaagaaacacctgaaggaagccagtgcagtcattgcagctgaccctctctattcagacggcgcgtggtccgagcccaccttcacgtccactgaagcagccatccagtccatgctggagtgcctgaagaacaacgaactcggcaaagctttgcggcagatcagggagtgcagaagtctgtggcccaatgacatctttggaagcagttctgatgatgaggtccagacactactgaatatttatttccgtcaccaaactctgggacagacgggtacttatgccctggtggggtctaaccagagcctgaccgagatctgcaccaagctgatggagctgaacatggagatccgggacatgatccgcagggcccagagttaccgagtcctcactacttttcttccagactccagtgtttctggcactagtctctgacaggagcctcctgtccccactgggttccaaactggcagtgctgccatgctggggcaacgtcattcagtgtcttctcggccttcaaaaggcttggacagactgttctccctcttgttacctgtagggctttttctaaagaggatggcagaacttccaacgtgtagcaatactataagaaccaaggtagcttagaacgtcctggacagactccactcatcatgctgtgtggcacaaatgtgttacatttgaccgagcatatgcaactcgctactgaagaagtgacttccgttgcataccaaagccgactacactgaacagtaccttcctttctagaaacaattttagattggcaaaagtgcaatgttttcttcactcaaaaaattttatattctcaaacatgtatattctttccctgtcttgttccattttcttttcttttttcttttttctttttcctttctttcgtgggctgagaaaggggcaggcaaaatgaagctggccactgaaaactgtaagatggtcaaaagctgacagcctgtgtatgtgaaaagggaattgtaaatggactgcaatgtaatgtacactgtaatttgaatacaattactgtatctaaaaggagctgctatgaagtacctttcttatgttgctaggctactgtttctgaaagccctggatctctttgcaccaaaaatggtccagatagactctttttaaggatcttggctgctttttactagaaggttgcttttatgagcatatttatactgctgaaggatgagtgttaattttaattaactttgccgttttgtagagaaaactattcacaagataaattccaagtcttttcacctgtcaggcatgcatattttaatatctgtttggatagtcagaagtagaatcataaaggtaaaatatgagttgttactttgtttcttcgatgtcatattttatgtgtaatatatatgtaaagggccattcttaagttctctccttaaacttaatgctgtcaagtgttagatgtgtgcatgtgaacttgttgcactgcagaaacatattcagagtttatctatgtaacttattcactctgtaaatacatttaaagtttttgtgatgtaagcttaattgatattctgttcagaactttctttagactaaaaaaaaaaaaaaagacaaaatacacgttgaccatggactttatttctggttaatgaaaatgtttgtcctgggcacacatgaagttttgcatgtgggttgccaaagtaataaccccaaggggcacccctcgcatgtatgatctgaatggcacccgtgggggtcatgccatgcatggccctgtgaagctggaggtaagtattatctctttggaagttggcatcaaaactgtgagcttcaaccaattctctgtaatcaaccaaagagaaaaatcagaaaaaagtgagagctctaattctccataacctataattaggttgtcatccttcaaatttggaagttaattctatagtgagcaggaaaaagtagtagagttgtaattctgtcaccaacacctatcccccaggaacacagggagaaacatgtaacaatctcatttatgccgtctttctactcatattttacatggaccaacaaatatagcttgctttactagcatatggctactgaatcattggcagtaatattctaggagtattctatagaagagagcctaacctaggattttttttaaatcctagtagttgctacagatgcaactactagattttaataattttctggactgctgaaaacatatttttctgatgatttatttttttcaacttgcctgaaagatgatttgctatgatttgtagaaacaactgaatcatgatctctctgaaaaatatcataaaataaaggtttctgtggctaaccacagtagacaactttcagagagttttgttgggagccacagtagaaagaacagattcgtcatgaactgagttttctaccatggcttcttacccagcagagaaccaccgtgatggtttactcttaaaaagggaaggaaaaaaaaaaaggatttcaacagtacattacaatccaagatattaacataggaagcagtggtctgtgtttttctcaattttatttttaaaaggagatgtattaatgtgaaaggtttcttctacttttcctctatctcttcacctcctctactttaagtggagatgggaaaaattgtgtaggatgcagccccacgccagcagagcccagcaataactttagatctaccagtcaaatcttgtcggctattgctctgtgcctctgttacagaagcattaatgttaattgccttccccagggatacaaagaagtagaagtaccaaaggaaagggtagatatttaacagatgcctcagtgataagaaagatgcctccttgtgtctcactgttttctagcactgaaacatgatacactttgtatccacctgcagaataaagcaatccagacaggcgctctgtaacttagacatcacttgattaaaattatagtctccaaatatagtgttttagaaaaggcactgcacatttttagaggcacgtgaatgtcattcccacctctaacccatctaacatcggtgagatgttaagaaaatgtgccgatgttactgtgaaataaagatgcctgtaattaattgtaggcatcacacacatgcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccataggtgagtattagggtatgttcattgtatctcaatgaaactagtttttaaagttttcaatgcatttgtttgagatcaattaatatttggatacctatcatgacccaggatatttctttgttcagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggatatccaaggaaaagagcattccagcaaaggaaaaaacacatgcagagaccctgaaggagaagcagggtcactttgtcaaagggacagcaaggaagccaatgaccgggtgaaatgagtgaagagagcgttcagagaggacagccaaaagctctgtgggccacggcaggactttgtcccttgctgagcaagatgggaagccactgaatgtttgcgggcagggtagtgacatgctgtgacttatgtttaaaaggattactccttcatagcgatgaagaaaagctctataacaaaagttccgttgtggtggttatacagcattgtgaatgtacttaatgccaatgaattgtgtactttaaaatggtaaattttatgttatatatgttttaccacaataaaaataatttttttaaa

SEQ ID NO: 135539 - DNA, 5119 bp, Homo sapiens
  Payload ID: 6503
  Gene Symbol: FUS
  Gene Name: FUS RNA binding protein
  Uniprot ID: P35637
  ENST ID: ENST00000254108
  CDS Start-End: 106-1686
acttaagcttcgacgcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaacatgggatgtcatgagtgttggcctaaatttgcccagctatggggaatttttcctttaccacatttatttgcatactggtcttagtttatttgcagcagtttatccctttttaagaactctttgatcttttggcccttttaatggtgaggctcaaacaaactacatttaaatggggcagtattcagatttgaccatggtggagagcgcttagccactctgggtctttcacaggaaggagagtaactgagtgctgcaggagtttgtggagtggagtcaggatctaggaggtgagtgactcccttcctagctgccctggtgaacagcgcttgggtagatacctgctataaggagactggtctggctgggttactttcacatcctgcctgtactcagagggcttgaggtcattgacattatgagattttaggcttgatccctttttgattggagggtggaaggccctcctaagggaatgataagtgataagagggggaaggggttgcagccaatgagttaaaaccttagagcagtgctcctcagcctcttaccatgtggttgtaaacttgcacgtacctgccaaccagttatttagcatgctttttattttagttacacagagcgtaacattaacccaagagcagaaaggttttatttacagggttttcgaacttggtttgtaagacagctgccatcacaagcatagcttacaaatgtgctggggacccctaattgggaagtgctttcctctcaaatttttattttttatttttagagacagagtcttgctctgtcatccaggctggagtgcagtggcgtgatctcggctcactgtagcctctgcctcctgagtttaagcgattctcctgcctcaggagaatcccagcttctgagtagctgagactacaggcgtgggccaccatgcccacctagtttttgcatttttagtggaggtgtggtttcactgtgttggccaggctggtctcttaactcctgacctcaggtgatccacctgccttggcctcccaaagtgctggaattacaggcatgagccgctgcatctggccatcctctcaaattttcaagtgttccacaagtatgttctctactgaagagttgctgcatccttgaatcttgggtgatttgaggcacagaaactatgactttattttttgagatggagttttgctcttgttgcccaggctggagtgcaatggcacgtttttcggcttaccgcaactgccgcctcctgggttcaagcgatagctgggattacaggcatgcgccaccatgcccagctaatttatttgtatttttagtagagacggggtttctccatgttggtcaggctggtctcgaactcccgacctcaggtgatgtgcacacctcagcctcccaataaaccatgacttttaagaggaatagcaggtttacttcccctgccagcattggggtgctctctaagcaacagtaggcggagagtggtctggcgtattaaaaacaaaggatcgtcaagtgggccttcccaggcattgctttgacttagtacatgtagaggatgtggcagttctctccgtccctgccactgctggtttctttgttaaatgtttagttgaaatggcctgatacgatatttgagtagttcactgttggtgctttgcctagcaggattctaatcttgctttggttgtggtcccctgatgccctcctgttaggagtggaggaggtcgaagctccttgtaagatatgattactgggaccattagtgtcaagttcctgtgtccttcaaatggcatatgtgattggccttgaccttaaaaggaaatagggtcccaggtgactgtttagtgggtaggtccagtttggggggatcttccaggagaatggatagagacacctagcagcagagagaacattggtgcctctcaagccaacctcccacctcagcctcccaagtagctgggactacaggtgcttcctcgctaccacacctgggtaattttttttttaattacttttttttttttaagaaacagggtttcactgggttgcccaggctggtcttgaactggcctcaagtgacctgcctgcctcagcctcccaaagtgctgggatcacaggtgtgacccactgcgtttggccagaatactctattcttactgaatgattgaaatctgtcttgaagcattaggtgtcccatttttgtgagttggaattgggacaggctaagtaggaagtgaggagggtggggagagctgtgctgtaggtctgtttgtcccttccttgatgtagccttcagttagccctttcagcttttttccccatcttgtgccgggccttcctgggtttcagtacttggatgtagggctgcagttatgtcagtggtgggtagattgaccaggaattaaggtctagggtccagcccatgtgagacttgactcactgatctacctttaggcatgtcttccttccagtctcatcctttttaaattttttttttttttttgagacggtctcactctcacccaggctggattgcagtggtgtgatctcgaccaactgcaacctctgcctcccacccgcaagctatctgcccacctcagcctctggagtagctgggacgggactacaggcacctgccaccatgactggctaatttttttttgtattttttgtggagatggggtcttgccatgttgctcaggctggtctggtctcaaaactgctctgggctcaagtgattgtcccactttggcctcccagagtgctgggattaaggtgtgagatactgtgtccggctatgaaaattttatttttaattaacttgtatatatttatggggtacaatgtcctatttctgtacatgtacacattgtggaatcaaatcaggctaatatatccatcacttcatatcattagcatgaatgagaacatacaaagccactcttagaaaattttgaaatttatgttatttcagcccttttatgctggaggttgcaaatgttttgtgaataatcagaccaaaaataaaaacaaaaaatgattgacttcagtcattcagtaagaa

SEQ ID NO: 135540 - DNA, 1818 bp, Homo sapiens
  Payload ID: 6503
  Gene Symbol: FUS
  Gene Name: FUS RNA binding protein
  Uniprot ID: P35637
  ENST ID: ENST00000380244
  CDS Start-End: 77-1654
gctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacagctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtt

SEQ ID NO: 135541 - DNA, 1787 bp, Homo sapiens
  Payload ID: 6503
  Gene Symbol: FUS
  Gene Name: FUS RNA binding protein
  ENST ID: ENST00000566605
  CDS Start-End: 78-869
tgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtt

SEQ ID NO: 135542 - DNA, 1785 bp, Homo sapiens
  Payload ID: 6503
  Gene Symbol: FUS
  Gene Name: FUS RNA binding protein
  ENST ID: ENST00000568685
  CDS Start-End: 65-1648
aggcgtcggtactcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgcagaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctgg

SEQ ID NO: 135543 - DNA, 1675 bp, Homo sapiens
  Payload ID: 6504
  Gene Symbol: FUZ
  Gene Name: fuzzy planar cell polarity protein
  Uniprot ID: Q9BT04
  ENST ID: ENST00000313777
  CDS Start-End: 165-1421
tgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaa

SEQ ID NO: 135544 - DNA, 1632 bp, Homo sapiens
  Payload ID: 6504
  Gene Symbol: FUZ
  Gene Name: fuzzy planar cell polarity protein
  ENST ID: ENST00000377092
  CDS Start-End: 168-404
gtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtgcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcaga

SEQ ID NO: 135545 - DNA, 703 bp, Homo sapiens
  Payload ID: 6504
  Gene Symbol: FUZ
  Gene Name: fuzzy planar cell polarity protein
  ENST ID: ENST00000528043
  CDS Start-End: 157-417
gcgggaagttaatcctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggctggtcccttcttcctctcctaggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgc

SEQ ID NO: 135546 - DNA, 1483 bp, Homo sapiens
  Payload ID: 6504
  Gene Symbol: FUZ
  Gene Name: fuzzy planar cell polarity protein
  ENST ID: ENST00000525370
  CDS Start-End: 51-311
aagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacaggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagcagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggcc

SEQ ID NO: 135547 - DNA, 1524 bp, Homo sapiens
  Payload ID: 6504
  Gene Symbol: FUZ
  Gene Name: fuzzy planar cell polarity protein
  ENST ID: ENST00000533418
  CDS Start-End: 157-1263
gcgggaagttaatcctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccgga

SEQ ID NO: 135548 - DNA, 679 bp, Homo sapiens
  Payload ID: 6504
  Gene Symbol: FUZ
  Gene Name: fuzzy planar cell polarity protein
  ENST ID: ENST00000529634
  CDS Start-End: 1-170
ggctgctgctcctccacctggaactgaagcgctgcctcttcaccgtggagcccttgggggataaagcagagccttcaccagaacagcgccggcgcctcctccgaaacttctataccctggtcacctccacgcacttcccaccagtgcctttacacgtaatgaaagaatgaaatcacttcatcctcacagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaa

SEQ ID NO: 135549 - DNA, 482 bp, Homo sapiens
  Payload ID: 6504
  Gene Symbol: FUZ
  Gene Name: fuzzy planar cell polarity protein
  ENST ID: ENST00000526575
  CDS Start-End: 73-333
actctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacaggtccttcttgtgggacttgaagaactgaccaatatccgcaacgtggagagactgaagaaggacttgagggctggtcccttcttcctctcctaggccagttattgcctcatcgacagcttcctgggggactcggagctcatcggggacctgacccagtgtgtggactgcgtgattcct

SEQ ID NO: 135550 - DNA, 1538 bp, Homo sapiens
  Payload ID: 6504
  Gene Symbol: FUZ
  Gene Name: fuzzy planar cell polarity protein
  ENST ID: ENST00000525130
  CDS Start-End: 85-345
acaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacaggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaagtcccaggcatccccc

SEQ ID NO: 135551 - DNA, 1479 bp, Homo sapiens
  Payload ID: 6504
  Gene Symbol: FUZ
  Gene Name: fuzzy planar cell polarity protein
  Uniprot ID: Q9BT04
  ENST ID: ENST00000528094
  CDS Start-End: 70-1218
ctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccgga

SEQ ID NO: 135552 - DNA, 679 bp, Homo sapiens
  Payload ID: 6504
  Gene Symbol: FUZ
  Gene Name: fuzzy planar cell polarity protein
  ENST ID: ENST00000527111
  CDS Start-End: 194-481
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcagcatcaccctcattgttctgtcatctgaggtgggcatctctgagctgaggctggagagactactccaaatggtgtttggagccatg

SEQ ID NO: 135553 - DNA, 584 bp, Homo sapiens
  Payload ID: 6504
  Gene Symbol: FUZ
  Gene Name: fuzzy planar cell polarity protein
  ENST ID: ENST00000526435
  CDS Start-End: 179-415
agggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcagcatcaccctcattgttctgtcatctgaggtgggcatctctgagctgaggctggaga

SEQ ID NO: 135554 - DNA, 550 bp, Homo sapiens
  Payload ID: 6504
  Gene Symbol: FUZ
  Gene Name: fuzzy planar cell polarity protein
  ENST ID: ENST00000527585
  CDS Start-End: 181-318
atagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcag

SEQ ID NO: 135555 - DNA, 584 bp, Homo sapiens
  Payload ID: 6504
  Gene Symbol: FUZ
  Gene Name: fuzzy planar cell polarity protein
  ENST ID: ENST00000525800
  CDS Start-End: 143-280
ctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggact

SEQ ID NO: 135556 - DNA, 572 bp, Homo sapiens
  Payload ID: 6504
  Gene Symbol: FUZ
  Gene Name: fuzzy planar cell polarity protein
  ENST ID: ENST00000529302
  CDS Start-End: 399-572
aaatacattccaggtggattaaaaattggttactaggcaacgatcgctggactcaaccaccctcgaaggttgtaggggagatggtgtttttctcgatttcgccccaaggagggtgctcggacttcgacgtgccgccatctttgagcagggcacagctgtttacagccttggaatggatatcaggctgaatggtggttgcttggcaacgccccgccacggtcgccatctttgactcccgttctctgtcatcggttccctcaatggagtccacatgtttgggcagaatctggaggtgcagctgagctctgcgaggaccgagaacacgactgtgcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctcca

SEQ ID NO: 135557 - DNA, 592 bp, Homo sapiens
  Payload ID: 6505
  Gene Symbol: FXYD1
  Gene Name: FXYD domain containing ion transport regulator 1
  Uniprot ID: O00168
  ENST ID: ENST00000351325
  CDS Start-End: 92-370
ctgggccagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagcactttgtcggtctcggtccctcagcgcgaaacgccagcgccactgggccccagca

SEQ ID NO: 135558 - DNA, 594 bp, Homo sapiens
  Payload ID: 6505
  Gene Symbol: FXYD1
  Gene Name: FXYD domain containing ion transport regulator 1
  Uniprot ID: O00168
  ENST ID: ENST00000455515
  CDS Start-End: 153-431
agggaggagacggggtgacctttcccacaggggcagcctgtggcgatgtggcagctgggcctcaccccggcagggctgtgcgtgaccccctgagtgggggaaggcaggctgttgccatggtggcctgagcgagcagaattcctccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 135559 - DNA, 486 bp, Homo sapiens
  Payload ID: 6505
  Gene Symbol: FXYD1
  Gene Name: FXYD domain containing ion transport regulator 1
  Uniprot ID: O00168
  ENST ID: ENST00000588715
  CDS Start-End: 47-325
ctctgtgtttgtgtgaggcagcgcctcctctgccctgccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctc

SEQ ID NO: 135560 - DNA, 428 bp, Homo sapiens
  Payload ID: 6505
  Gene Symbol: FXYD1
  Gene Name: FXYD domain containing ion transport regulator 1
  Uniprot ID: O00168
  ENST ID: ENST00000589209
  CDS Start-End: 120-398
tgtgtagggctggttgcgtcactgcgtgggggcaccggaggcccagaggaggagtattggatgcctgacggtgtttacaccccacgtcctgctccaaccagcagtttggggagaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccagg

SEQ ID NO: 135561 - DNA, 645 bp, Homo sapiens
  Payload ID: 6505
  Gene Symbol: FXYD1
  Gene Name: FXYD domain containing ion transport regulator 1
  Uniprot ID: O00168
  ENST ID: ENST00000588081
  CDS Start-End: 59-337
ccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggggctggacgtcccccctcgcctctcacccttttcaccctcacaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 135562 - DNA, 512 bp, Homo sapiens
  Payload ID: 6505
  Gene Symbol: FXYD1
  Gene Name: FXYD domain containing ion transport regulator 1
  ENST ID: ENST00000589121
  CDS Start-End: 1-347
ttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgaccccgcccctcgcgagggcgagctggagctacagcgccgcttggcgcccgccgggagggagcctcagcttctcctacctctccacgcccacaggcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgaca

SEQ ID NO: 135563 - DNA, 619 bp, Homo sapiens
  Payload ID: 6505
  Gene Symbol: FXYD1
  Gene Name: FXYD domain containing ion transport regulator 1
  Uniprot ID: O00168
  ENST ID: ENST00000588607
  CDS Start-End: 192-470
gtgaggcagcgcctcctctgccctgccaggctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacg

SEQ ID NO: 135564 - DNA, 690 bp, Homo sapiens
  Payload ID: 6505
  Gene Symbol: FXYD1
  Gene Name: FXYD domain containing ion transport regulator 1
  Uniprot ID: O00168
  ENST ID: ENST00000612146
  CDS Start-End: 245-523
ggccaacccaagagggagggagtgtggttgaggcagtgggttctgcagggtgggatgtgggtgactcctccctgccctgctggtgcgtgtgcaccctggcagggtgtggagttgggacacacacgtgtgtagggctggttgcgtcactgcgtgggggcaccggaggcccagaggaggagtattggatgcctgacggtgtttacaccccacgtcctgctccaaccagcagtttggggagaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacagc

SEQ ID NO: 135565 - DNA, 513 bp, Homo sapiens
  Payload ID: 6506
  Gene Symbol: FXYD2
  Gene Name: FXYD domain containing ion transport regulator 2
  Uniprot ID: P54710
  ENST ID: ENST00000260287
  CDS Start-End: 80-274
gccactctccatccaggccccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacc

SEQ ID NO: 135566 - DNA, 571 bp, Homo sapiens
  Payload ID: 6506
  Gene Symbol: FXYD2
  Gene Name: FXYD domain containing ion transport regulator 2
  Uniprot ID: P54710
  ENST ID: ENST00000292079
  CDS Start-End: 67-267
agacactctccaaaaagcagagacagcaggaagaggggagtggaggcagcccattcacctggggaaatgactgggttgtcgatggacggtggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccggg

SEQ ID NO: 135567 - DNA, 672 bp, Homo sapiens
  Payload ID: 6506
  Gene Symbol: FXYD2
  Gene Name: FXYD domain containing ion transport regulator 2
  Uniprot ID: P54710
  ENST ID: ENST00000528014
  CDS Start-End: 169-363
ccagccccgcagctgctccccatctctctgccaactgccagaacgacacaggaagctggggccggtgcctcagtgtgaagagggggagtgccactctccatccaggccccaggcaagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccgggtctca

SEQ ID NO: 135568 - DNA, 562 bp, Homo sapiens
  Payload ID: 6506
  Gene Symbol: FXYD2
  Gene Name: FXYD domain containing ion transport regulator 2
  Uniprot ID: P54710
  ENST ID: ENST00000532119
  CDS Start-End: 56-250
caagcagcacctccctgctctcctgcactcctggacacaaccagcagctcctgccatggacaggtggtacctgggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagtttccataccttccaccccactgctccccagagagaaatgtgacaatgagcttcagctctgtcgaatccggactacatggaacctctctgggttggcttctcaaccgatttcagagttgtgagctgagaaagaacagcaggagagaggccacagttattcaggggactcctgccttgctgggggcttccgcagcccctgaccaaccatcctggtgtcactgctgagacagcagcctgaacaagggcaatgggaccccagagactgcatctgtacaggcggagccccagggctttagaccctttgct

SEQ ID NO: 135569 - DNA, 1320 bp, Homo sapiens
  Payload ID: 6507
  Gene Symbol: FXYD3
  Gene Name: FXYD domain containing ion transport regulator 3
  Uniprot ID: Q14802
  ENST ID: ENST00000346446
  CDS Start-End: 113-454
aggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 135570 - DNA, 1404 bp, Homo sapiens
  Payload ID: 6507
  Gene Symbol: FXYD3
  Gene Name: FXYD domain containing ion transport regulator 3
  Uniprot ID: Q14802
  ENST ID: ENST00000344013
  CDS Start-End: 197-538
aggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 135571 - DNA, 1467 bp, Homo sapiens
  Payload ID: 6507
  Gene Symbol: FXYD3
  Gene Name: FXYD domain containing ion transport regulator 3
  Uniprot ID: Q14802
  ENST ID: ENST00000435734
  CDS Start-End: 260-601
gttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctc

SEQ ID NO: 135572 - DNA, 780 bp, Homo sapiens
  Payload ID: 6507
  Gene Symbol: FXYD3
  Gene Name: FXYD domain containing ion transport regulator 3
  Uniprot ID: Q14802
  ENST ID: ENST00000604255
  CDS Start-End: 148-582
aggtttgcttagggcgtggcagcttcggataaacgcaggactccgcctggcagcccgatttctcccggaacctctgctcagcctggtgaaccacacagaggctggggcgaggaggataccatctgtcagtcttggctggatgacatcatgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgccc

SEQ ID NO: 135573 - DNA, 573 bp, Homo sapiens
  Payload ID: 6507
  Gene Symbol: FXYD3
  Gene Name: FXYD domain containing ion transport regulator 3
  Uniprot ID: Q14802
  ENST ID: ENST00000603449
  CDS Start-End: 57-242
gatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatggtgagagcccgtgccccctttcccctccccacaaccccacatactgcttggtgccaagggttcccatacagggttggggcctgacgtgagcatcacaggacaaagatacgaagggactaggatggggttactgaatatgccacacagtggattaaaggaactagaggcagcaacctggcctttgggaaggttctattccagcaagatagacacacgcaggaggtgaggacagtttgcaagaagccattggttggttcagatcaactgctgggagaagtgttgacttgagaaaacttcctggaggtggtgagctattggatcaaaaccctcatctggcctccaggttccaatgacctgctccctactccccgctctgccctcacctctccacgctcctcattccttctgctccaagcctct

SEQ ID NO: 135574 - DNA, 742 bp, Homo sapiens
  Payload ID: 6507
  Gene Symbol: FXYD3
  Gene Name: FXYD domain containing ion transport regulator 3
  ENST ID: ENST00000603524
  CDS Start-End: 197-547
gggcaaggtggaggaagtgccagctctcgctatcaaaattataactaggccaggcgtggtggctcacacctgtaatcccagcactgagggaggccggggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatggtgctccatatatatttgtcaagagaatggggggacagatggagaggacacaggctggcactgaggtcccctccactttcctcctagactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctg

SEQ ID NO: 135575 - DNA, 1322 bp, Homo sapiens
  Payload ID: 6507
  Gene Symbol: FXYD3
  Gene Name: FXYD domain containing ion transport regulator 3
  Uniprot ID: Q14802
  ENST ID: ENST00000604404
  CDS Start-End: 192-455
tggaaggggactttaagttctccacaactgccagcaatccttccaccaggcaaaacacatcatctaaggaaaagaagtgaggtttgcttagggcgtggcagcttcggataaacgcaggactccgcctggcagcccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaagcagcctggagacttcctatgtgtgcattggggtggggcttggggcaccatgagaaggttggcgtgccctggaggctgacacagaggctggcactgagcctgcttgttgggaaaagcccacaggcctgttcccttgtggcttgggacatggcacaggcccgccctctgcctcctcagccatgggaacctcatatgcaatttgggatttactagtagccaaaaggaatgaaagagagctctaaccagatggaacactggaacattccagtggaccctggaccattccaggaaaactgggacataggatcgtcccgctatgatggaagtgttcagacagtttataatagtaagcccctgtgaccctctcacttaccccgagacctcactttattacaagatctttccaaatacccaaatgtccctgcaagcccgttaaataattccctatgctacccttaataacatacaatgaccacatagtgtgagaacttccaacaagcctcaaagtcccttgagactccccaatacctaataaggcatgcgaaatgttctcatgaactaccccacaacacgcctaaaactcaaaacacccaaaaatatctcctccaatgtcctgaaacatgaacccaaaaagagacccacaataaactcgtgacttgtcccctca

SEQ ID NO: 135576 - DNA, 590 bp, Homo sapiens
  Payload ID: 6507
  Gene Symbol: FXYD3
  Gene Name: FXYD domain containing ion transport regulator 3
  ENST ID: ENST00000605550
  CDS Start-End: 56-268
atttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccgggtaagatactgttccggcatgcccgcctcaggctgactggacgcttttcagggtgaaagggctaactctcccagcaggagaggcctcggggctctgccctttagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaagaaccctctatccggagggagagggcaaatgggggcggacaccaatctcaccacttttgtctccttagtcaccatcca

SEQ ID NO: 135577 - DNA, 548 bp, Homo sapiens
  Payload ID: 6507
  Gene Symbol: FXYD3
  Gene Name: FXYD domain containing ion transport regulator 3
  Uniprot ID: Q14802
  ENST ID: ENST00000604621
  CDS Start-End: 85-348
cttatgctgagcaggtctacctgggaaagagaaagtgtttgctgtcaccaggaactctgctgggcctagggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaa

SEQ ID NO: 135578 - DNA, 633 bp, Homo sapiens
  Payload ID: 6507
  Gene Symbol: FXYD3
  Gene Name: FXYD domain containing ion transport regulator 3
  Uniprot ID: Q14802
  ENST ID: ENST00000605677
  CDS Start-End: 15-305
gccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgagtggaggagctcgggggagcaggcgggccggggctggggctcccctcccctgaccactcagctctccccaacaggtgcaaaatgcaaatgcaagtttggccagaagtccgggtaagatactgttccggcatgcccgcctcaggctgactggacgcttttcagggtgaaagggctaactctcccagcaggagaggcctcggggctctgccctttagagttcctgccgctaagatttccaggtttattgtttctagctggtaatccccagggggccccaaatcctgaaatgctttggcccctgggattgcacaaccccccaaatggaaaggcagccaggaagacatgtctgggcaggctaagaaccctctatccggagggagagggcaaatgggggcggacaccaatctcaccacttttgtctccttagtcaccatccaggggag

SEQ ID NO: 135579 - DNA, 758 bp, Homo sapiens
  Payload ID: 6507
  Gene Symbol: FXYD3
  Gene Name: FXYD domain containing ion transport regulator 3
  Uniprot ID: Q14802
  ENST ID: ENST00000603181
  CDS Start-End: 295-558
tctaaggaaaagaagtgaggtcggaacaccaacgcatcatctcactgcatggccctggaggctctgccgtttaaagaccccagaaccttccccattcaaggtttgcttagggcgtggcagcttcggataaacgcaggactccgcctggcagcccgatttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattgtgcctctgcccaa

SEQ ID NO: 135580 - DNA, 837 bp, Homo sapiens
  Payload ID: 6507
  Gene Symbol: FXYD3
  Gene Name: FXYD domain containing ion transport regulator 3
  Uniprot ID: Q14802
  ENST ID: ENST00000605552
  CDS Start-End: 139-324
tttctcccggaacctctgctcagcctggtgaaccacacaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatggtgagagcccgtgccccctttcccctccccacaaccccacatactgcttggtgccaagggttcccatacagggttggggcctgacgtgagcatcacaggacaaagatacgaagggactaggatggggttactgaatatgccacacagtggattaaaggaactagaggcagcaacctggcctttgggaaggttctattccagcaagatagacacacgcaggaggtgaggacagtttgcaagaagccattggttggttcagatcaactgctgggagaagtgttgacttgagaaaacttcctggaggtggtgagctattggatcaaaaccctcatctggcctccaggttccaatgacctgctccctactccccgctctgccctcacctctccacgctcctcattccttctgctccaagcctctcagacacagcagacatactgccagcctcagacctctgcacctgctggttcctctgcctggaacacttccttccacagaaccacatggctccctcccttccctctgctcaaatgcagccccctgagaggccttccctgacaactccctctaaaagagctgccatctgactttttttttgtttt

SEQ ID NO: 135581 - DNA, 564 bp, Homo sapiens
  Payload ID: 6507
  Gene Symbol: FXYD3
  Gene Name: FXYD domain containing ion transport regulator 3
  ENST ID: ENST00000604804
  CDS Start-End: 56-406
atttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatggtgctccatatatatttgtcaagagaatggggggacagatggagaggacacaggctggcactgaggtcccctccactttcctcctagactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctcttt

SEQ ID NO: 135582 - DNA, 770 bp, Homo sapiens
  Payload ID: 6508
  Gene Symbol: FXYD4
  Gene Name: FXYD domain containing ion transport regulator 4
  Uniprot ID: P59646
  ENST ID: ENST00000476166
  CDS Start-End: 335-604
agatccgttctctgcgctgccagctcaggtgagccctcgccaaggtgacctcgcaggacactggtgaaggagcagtgaggaacctgcagagtcacacagttggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccacccc

SEQ ID NO: 135583 - DNA, 778 bp, Homo sapiens
  Payload ID: 6508
  Gene Symbol: FXYD4
  Gene Name: FXYD domain containing ion transport regulator 4
  Uniprot ID: P59646
  ENST ID: ENST00000616495
  CDS Start-End: 340-609
atccgttctctgcgctgccagctcaggtgagccctcgccaaggtgacctcgcaggcacagttttgagctcttagcttgtgcttactcaatccacacaactcccccaggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggcctgactgccttggaagccaatgacccatttgccaataaagacgatcccttctactatgactggaaaaacctgcagctgagcggactgatctgcggagggctcctggccattgctgggatcgcggcagttctgagtggcaaatgcaaatgcaagagcagccagaagcagcacagtcctgtacctgagaaggccatcccactcatcactccaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctc

SEQ ID NO: 135584 - DNA, 1580 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000342879
  CDS Start-End: 779-1315
tccacgaggctgccggcttaggacccccagctccgacgtaagtccctctcgtgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttg

SEQ ID NO: 135585 - DNA, 632 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000392217
  CDS Start-End: 43-366
tgcacaccagctgtgtagatgtgggagaggggtttcttccagatgcagactctcagtaatatcccttgtttctgcctccatggctcactcctgccctccactgatctggccactctctcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgc

SEQ ID NO: 135586 - DNA, 763 bp, Homo sapiens
  Payload ID: 6509
  Gene Symbol: FXYD5
  Gene Name: FXYD domain containing ion transport regulator 5
  ENST ID: ENST00000392218
  CDS Start-End: 81-371
acaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatggcgcctatatcacagcttatggagtcacacacttcttgatgaacatgttggctgtttccagctttttctgtctacacacagcaccacaatgagcaactttgtcccttcctccttgagcaaacgcacttggaatatgtactgactatgtgctggtcatggttctaaatattttgcgtatgttaactcattcaaccttcacgcaaaccctaagaggcagaaattaccattgtccccattttacagacaaggaaacagaggctgtgagtaactggttcaaggtctcacaacaagtcagggacgcagctggaatcgaagtccaggaatctggcaccagagcctgtgcttttatccaagacaatacagggcaaaggacatgcatgcttaatgttttaaaatttgccctcctgccgcccaggcacagtggctcatgcctgtcatcccagcacttttggaggctgaggcgggtggatcgcttgagcccagg

SEQ ID NO: 135587 - DNA, 872 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000392219
  CDS Start-End: 68-604
ggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgccc

SEQ ID NO: 135588 - DNA, 892 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000423817
  CDS Start-End: 92-628
tgggctacagtgggccgctctgcctcgctcccgcccgcctgcctcagtctccccagctctctgccacccccctcggaccagtgcctcttagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtcttt

SEQ ID NO: 135589 - DNA, 898 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000541435
  CDS Start-End: 118-654
gccaccgccgcgtccctctctccacgaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaa

SEQ ID NO: 135590 - DNA, 1003 bp, Homo sapiens
  Payload ID: 6509
  Gene Symbol: FXYD5
  Gene Name: FXYD domain containing ion transport regulator 5
  ENST ID: ENST00000543307
  CDS Start-End: 81-665
acaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtgagaactggggttgggtgggaaggacaccaagaccaggagggggacttatgacggagggctgggttctcaaaggtccctgggcaattttgttttaaatgaggtatctattagctgcatatacatacaaaccaccacagaattcagtggtttaaaataatgaccatttattgagctctcaataccacagtttggaaacataggctgggctcagctgggtgattcttctggtctcaactggatttactcttgcatctgagttcagttgtgggtcagcaggaaactttgtttctggggtgccttggctctttgccacatcatcttatccttcactaagctagcctgggcttgttcgcatggtggtggcagggatctaagatagagtgaatgcatgcaggctcagaactggccattatcacttctgcctcattccata

SEQ ID NO: 135591 - DNA, 883 bp, Homo sapiens
  Payload ID: 6509
  Gene Symbol: FXYD5
  Gene Name: FXYD domain containing ion transport regulator 5
  ENST ID: ENST00000592290
  CDS Start-End: 64-435
gcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccaggtgaggaaagggacacatctatcaagatcctgtcattgcaaataacaacagcaacaaaaatcccaaacttggaccaaacaagggaatttatggatttatgtaacgaaaaagtccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctccc

SEQ ID NO: 135592 - DNA, 862 bp, Homo sapiens
  Payload ID: 6509
  Gene Symbol: FXYD5
  Gene Name: FXYD domain containing ion transport regulator 5
  Uniprot ID: Q96DB9
  ENST ID: ENST00000590686
  CDS Start-End: 76-612
gccaccgccgcgtccctctctccacgaggctgccggcttaggacccccagctccgaccatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaa

SEQ ID NO: 135593 - DNA, 927 bp, Homo sapiens
  Payload ID: 6509
  Gene Symbol: FXYD5
  Gene Name: FXYD domain containing ion transport regulator 5
  ENST ID: ENST00000588699
  CDS Start-End: 24-608
ggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtgagaactggggttgggtgggaaggacaccaagaccaggagggggacttatgacggagggctgggttctcaaaggtccctgggcaattttgttttaaatgaggtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtcttt

SEQ ID NO: 135594 - DNA, 729 bp, Homo sapiens
  Payload ID: 6509
  Gene Symbol: FXYD5
  Gene Name: FXYD domain containing ion transport regulator 5
  ENST ID: ENST00000496493
  CDS Start-End: 44-247
cctctctccacgaggctgccggcttaggacccccagctccgacatgtcgccctctggtcgcctgtgtcttctcaccatcgttggcctgattctccccaccagaggttggaacagactgtgggggcggagacaggagcagggagcccaagaaggaggctgctgggatgtccaggctggagggtacagaggcaggaccaggatgggggcagtggagttatccagcactgaccacatggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggag

SEQ ID NO: 135595 - DNA, 1929 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000260282
  CDS Start-End: 321-608
agccagcccgactcctaggaggaggggaggcgggaaagcagctcaagcctcacccaccgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtgtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtg

SEQ ID NO: 135596 - DNA, 1033 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000524656
  CDS Start-End: 298-585
agtctcctcctcgactcctctctggaacattgctggctgggcggggcgggcaatcatttcaagttaggtgatttaacaataattgatgcttaattgtttatttgatgggcatttaaaatgcaaattgagggaactggttgcattttccactgatggatctgtggcctctggtcgacccaaagcacttgttttaaaaggcagctttaaaagcccttgatggttgtttgtttgctctgaggctctgaaccagagaagcccagctcctgttacagattcatcaaatgccggaaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccct

SEQ ID NO: 135597 - DNA, 1799 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000527717
  CDS Start-End: 194-481
atgctccaagtcgcgtcacaggcagggttgccgagccaggatttatttacatcttcacattcaaagttcgtcatcatgaattttgactcttggggactgggctgaggacggggtggtactgctcctggcagggccagaggtggatggggcttgaaaagggggttcaaggcagcagatctatggttcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttccta

SEQ ID NO: 135598 - DNA, 571 bp, Homo sapiens
  Payload ID: 6510
  Gene Symbol: FXYD6
  Gene Name: FXYD domain containing ion transport regulator 6
  ENST ID: ENST00000524841
  CDS Start-End: 138-410
acattcaaagttcgtcatcatgaattttgactcttggggactgggctgaggacggggtggtactgctcctggcagggccagaggtggatggggcttgaaaagggggttcaaggcagcagatctatggttcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatggtaactgtccgtgaccacctgcccaggtggaaaagagggaacagagagacccctctgtggctcaggaagggactgttgccagcaacagagccccagaaagcagagaactgaagtgcagccatcaggtggaagcctctggaacctgaggcggctgcttgaacctttggatgcaaat

SEQ ID NO: 135599 - DNA, 2171 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000526014
  CDS Start-End: 597-884
aattaccaaggctcccaattaacgtgggctgctgtgtctggtgctgggttattttctcctatttttccgttcctcggggtttactattgcagagagacaccaggtctgtcattgtgcctgtcttgctcccttcccaccctaaccagagggaaaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacag

SEQ ID NO: 135600 - DNA, 708 bp, Homo sapiens
  Payload ID: 6510
  Gene Symbol: FXYD6
  Gene Name: FXYD domain containing ion transport regulator 6
  ENST ID: ENST00000529335
  CDS Start-End: 134-469
ctaggaggaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccagcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtg

SEQ ID NO: 135601 - DNA, 2132 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000539526
  CDS Start-End: 522-809
aaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtggc

SEQ ID NO: 135602 - DNA, 579 bp, Homo sapiens
  Payload ID: 6510
  Gene Symbol: FXYD6
  Gene Name: FXYD domain containing ion transport regulator 6
  Uniprot ID: Q9H0Q3
  ENST ID: ENST00000530956
  CDS Start-End: 201-488
aagcctcacccaccgccctgcccccagccccgccactcccaggctcctcgggactcggcgggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccactt

SEQ ID NO: 135603 - DNA, 669 bp, Homo sapiens
  Payload ID: 6510
  Gene Symbol: FXYD6
  Gene Name: FXYD domain containing ion transport regulator 6
  ENST ID: ENST00000584394
  CDS Start-End: 79-351
agccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggg

SEQ ID NO: 135604 - DNA, 566 bp, Homo sapiens
  Payload ID: 6510
  Gene Symbol: FXYD6
  Gene Name: FXYD domain containing ion transport regulator 6
  ENST ID: ENST00000584230
  CDS Start-End: 137-409
ctcctgggagtctcggaggggaccggctgtgcaggtttgggccttgacgtggctgtggatgcagtcgttctgacccctggtggccgagaggtgaagtgcagtggcggctgcttgctcaaggccggaggaagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatggtaactgtccgtgaccacctgcccaggtggaaaagagggaacagagagacccctctgtggctcaggaagggactgttgccaggtgcatggccagccagacatgctcccgcagtgccaggagagtgggtctccagggcctctgcagcattgccccctcactccaccaaacag

SEQ ID NO: 135605 - DNA, 712 bp, Homo sapiens
  Payload ID: 6511
  Gene Symbol: FXYD7
  Gene Name: FXYD domain containing ion transport regulator 7
  Uniprot ID: P58549
  ENST ID: ENST00000270310
  CDS Start-End: 85-327
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctct

SEQ ID NO: 135606 - DNA, 636 bp, Homo sapiens
  Payload ID: 6511
  Gene Symbol: FXYD7
  Gene Name: FXYD domain containing ion transport regulator 7
  ENST ID: ENST00000588265
  CDS Start-End: 56-409
gctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagtaagtgcgacccattcctgggctgcctcagcctccgcttcctctgctggctttcatccatatcctacccgctatgtcctgtcttcttgttctgtctctctctcccaacaggcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctcc

SEQ ID NO: 135607 - DNA, 456 bp, Homo sapiens
  Payload ID: 6511
  Gene Symbol: FXYD7
  Gene Name: FXYD domain containing ion transport regulator 7
  ENST ID: ENST00000586063
  CDS Start-End: 85-318
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagcc

SEQ ID NO: 135608 - DNA, 670 bp, Homo sapiens
  Payload ID: 6512
  Gene Symbol: FXYD6-FXYD2
  Gene Name: FXYD6-FXYD2 readthrough
  ENST ID: ENST00000532984
  CDS Start-End: 82-420
cccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaaggccccaggagatgaggaagcccaggtggagaacctcatcaccgccaatgcaacagagccccagaaagcagagaactgaagtgcagccatcaggtggaaggcggcagccccaagggggacgtggacccgttctactatggcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgt

SEQ ID NO: 135609 - DNA, 634 bp, Homo sapiens
  Payload ID: 6512
  Gene Symbol: FXYD6-FXYD2
  Gene Name: FXYD6-FXYD2 readthrough
  ENST ID: ENST00000614497
  CDS Start-End: 43-477
gtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacagagccccagaaagcagagaactgaagtgcagccatcaggtggaaggcggcagccccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgaccc

SEQ ID NO: 135610 - DNA, 4750 bp, Homo sapiens
  Payload ID: 6513
  Gene Symbol: FYB
  Gene Name: FYN binding protein
  Uniprot ID: O15117
  ENST ID: ENST00000351578
  CDS Start-End: 192-2543
accactgaccgggacaaaaccctgccaggcatcagaaagctccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttaactcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttggccagctttagtttgaggactccttgataagcttgctaaactttcagagtgccctgagacacttccagccatccctcctcctgccttcattggggcagacttgcattgcagtctgacagtaattttttttctgattgagaattatgtaaattcagtacaatgtcagtttttaaaagtcaaagttagatcaagagaatatttcagagttttggtttacacatcaagaaacagacacacatacctaggaaagatttacacaatagataatcatcttaatgtgaaagatatttgaagtattaattttaatatattaaatatgatttctgttatagtcttctgtatggaattttgtcacttaagatgagctgcaaataaataataccttcaatggataaccttgcctcctacttc

SEQ ID NO: 135611 - DNA, 594 bp, Homo sapiens
  Payload ID: 6513
  Gene Symbol: FYB
  Gene Name: FYN binding protein
  ENST ID: ENST00000504542
  CDS Start-End: 590-594
gcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggcgatgcaaaccagtaatgcagaatcctattgctctataaaaatttgaattgcttgaatctattacaaatttttgccagtgtgcttcctgcctcaaggatggatggaaaggcagatgtaaagtccctcatggc

SEQ ID NO: 135612 - DNA, 688 bp, Homo sapiens
  Payload ID: 6513
  Gene Symbol: FYB
  Gene Name: FYN binding protein
  ENST ID: ENST00000506557
  CDS Start-End: 502-688
atcagaaagctccgcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccac

SEQ ID NO: 135613 - DNA, 589 bp, Homo sapiens
  Payload ID: 6513
  Gene Symbol: FYB
  Gene Name: FYN binding protein
  ENST ID: ENST00000509072
  CDS Start-End: 523-589
gcagttcttgagttccacatgcagagcagatgcgacagctagaagtgagtagggcccagaccctggcccaggaagatccactaaaggaggccatccttccgccttcttctgcaggagtcagggggcgtgtaaaggtgatttgttcgccaagaaaagcacttttagtaaagcacagatgttaatctagatcatggaaaagtgccacacactagatttagcacataagcaaggagtctctagaacactcagaagaaaatgaatgaatccatgaatgaatggacaagtgagagcccagagcagctgaagccatgaagtgctttggaaagagaagcgtgcctgggaaaagagagtggctgagtgctaagagcagggtgaacaccatggaaaacttgaaattgaaaacatcacaattttaatgagaaaaagcgcaacccaaagtgaagagcaccattataacaaaggtcatgcaggctgagtgaattatcctaaacaaatgatggaaaggcagatgtaaagtccctcatggcgaaatataacacggggggcaacccgacagaggatgtctcagtcaatagccgacccttcagag

SEQ ID NO: 135614 - DNA, 583 bp, Homo sapiens
  Payload ID: 6513
  Gene Symbol: FYB
  Gene Name: FYN binding protein
  ENST ID: ENST00000512138
  CDS Start-End: 240-583
gcacattcactatccaagctgcaccatcttcggggtcattgtgtgccaggcatatcaactcttttcaataaaaatgtttttctagccacttcccagcactcgcagcatgaagctcacaccagaagtttccagagatcaccccagaggtgataagatctcgcccgcccttccgtcccaggatagtgtgattgcgggaccatggaatttacaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccc

SEQ ID NO: 135615 - DNA, 2747 bp, Homo sapiens
  Payload ID: 6513
  Gene Symbol: FYB
  Gene Name: FYN binding protein
  Uniprot ID: O15117
  ENST ID: ENST00000512982
  CDS Start-End: 87-2606
gcatagctaacttgcacattcactatccaagctgcaccatcttcggggtcattgtgtgccaggcatatcaactcttttcaataaaaatggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttac

SEQ ID NO: 135616 - DNA, 2578 bp, Homo sapiens
  Payload ID: 6513
  Gene Symbol: FYB
  Gene Name: FYN binding protein
  Uniprot ID: O15117
  ENST ID: ENST00000515010
  CDS Start-End: 68-2419
cttttgtctctcagctattttttgttccctatgtttgtaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttga

SEQ ID NO: 135617 - DNA, 676 bp, Homo sapiens
  Payload ID: 6513
  Gene Symbol: FYB
  Gene Name: FYN binding protein
  ENST ID: ENST00000510188
  CDS Start-End: 154-676
aatacaattagagaaccataaagggcaaacatattaaaagagcttaattttgtagtgtggcctgcaggcttccagaaaaaaacaggagatcagtgagctagcagcagagaagccttcctggaaaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactg

SEQ ID NO: 135618 - DNA, 2789 bp, Homo sapiens
  Payload ID: 6513
  Gene Symbol: FYB
  Gene Name: FYN binding protein
  Uniprot ID: O15117
  ENST ID: ENST00000505428
  CDS Start-End: 159-2648
agaaagctccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttac

SEQ ID NO: 135619 - DNA, 2009 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000229471
  CDS Start-End: 104-1552
aaatgatcaagtgttgggtataagccaaggagctgagagagggggagaccagcgcaggtctgaggagctgagaagggaggcttacgtgaagggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 135620 - DNA, 3628 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000354650
  CDS Start-End: 608-2221
agagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 135621 - DNA, 2416 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000368667
  CDS Start-End: 346-1959
aagagaacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 135622 - DNA, 2573 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000368678
  CDS Start-End: 516-2120
cgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaa

SEQ ID NO: 135623 - DNA, 3234 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000368682
  CDS Start-End: 223-1827
cccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 135624 - DNA, 989 bp, Homo sapiens
  Payload ID: 6514
  Gene Symbol: FYN
  Gene Name: FYN proto-oncogene, Src family tyrosine kinase
  ENST ID: ENST00000462856
  CDS Start-End: 293-989
gtataagccaaggagctgagagagggggagaccagcgcaggtctgaggagctgagaagggaggcttacgtgaagggtaagactcgcatgggcctggccggtggacaagatgtgggaactgcatggacagttatgtggaggtgcattccatcctggctggagagtgtgtgaggggcagtgggagattggtggaaaagatataggccactggtgtggaaggctgggaagccacgcttcagatcggagaaagttgctaatcagagaagcggcgttctggaggtggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcag

SEQ ID NO: 135625 - DNA, 609 bp, Homo sapiens
  Payload ID: 6514
  Gene Symbol: FYN
  Gene Name: FYN proto-oncogene, Src family tyrosine kinase
  ENST ID: ENST00000521062
  CDS Start-End: 301-609
atcatctgatagccataggatgtcatccaaacttgtgtcatggtcctgtaatgttcccgggtttgtggagtgaagaaaataacacttgggtatttggaatttattcttaagctgtttttgtcagggatggatgagtttctcattcttgagttgaaatgaaacttttaaatattcttaataactgtcttatcgccagaccctctgcatgagacaccaagggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagtttt

SEQ ID NO: 135626 - DNA, 597 bp, Homo sapiens
  Payload ID: 6514
  Gene Symbol: FYN
  Gene Name: FYN proto-oncogene, Src family tyrosine kinase
  ENST ID: ENST00000523570
  CDS Start-End: 250-597
atttttcttatcagtaaagtggtccctttcacaggaccaagtaaaattactcgcttttaaattgaaaaacacaaaccaaatacattttgtttttgtttttgttttctgacttgggtcttgaattaaaatggaaaaagggctgttggccaccagtctaaagaatgccaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaa

SEQ ID NO: 135627 - DNA, 541 bp, Homo sapiens
  Payload ID: 6514
  Gene Symbol: FYN
  Gene Name: FYN proto-oncogene, Src family tyrosine kinase
  ENST ID: ENST00000524310
  CDS Start-End: 107-541
acataataaagcctagaaaagaaaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccag

SEQ ID NO: 135628 - DNA, 1012 bp, Homo sapiens
  Payload ID: 6514
  Gene Symbol: FYN
  Gene Name: FYN proto-oncogene, Src family tyrosine kinase
  ENST ID: ENST00000518295
  CDS Start-End: 554-1012
agtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttgacagggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaa

SEQ ID NO: 135629 - DNA, 712 bp, Homo sapiens
  Payload ID: 6514
  Gene Symbol: FYN
  Gene Name: FYN proto-oncogene, Src family tyrosine kinase
  ENST ID: ENST00000484067
  CDS Start-End: 393-712
gcccgccgcccggcggcgagagtagaggcgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggaga

SEQ ID NO: 135630 - DNA, 864 bp, Homo sapiens
  Payload ID: 6514
  Gene Symbol: FYN
  Gene Name: FYN proto-oncogene, Src family tyrosine kinase
  ENST ID: ENST00000520518
  CDS Start-End: 306-864
cctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggacattttgggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcac

SEQ ID NO: 135631 - DNA, 825 bp, Homo sapiens
  Payload ID: 6514
  Gene Symbol: FYN
  Gene Name: FYN proto-oncogene, Src family tyrosine kinase
  ENST ID: ENST00000462598
  CDS Start-End: 616-825
agatctcctcccctcccagagggtccaagagaacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggacattttggaaagcaaatgagaatgagcgactgtaacccttgcctgttgttcataagcatgtacaccaggatctgtgtgatccttttcctgaagataaacagcatactgctcaaggaaggaaaacaacgcatagcaacaaatttcctgttttttaaagaaagatccaacttggtttagaaattatgctggcttgctttctatgtttctaatagagaataaggagaaacttgcttctcatttgccgacatgaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggagtgacactcttt

SEQ ID NO: 135632 - DNA, 571 bp, Homo sapiens
  Payload ID: 6514
  Gene Symbol: FYN
  Gene Name: FYN proto-oncogene, Src family tyrosine kinase
  ENST ID: ENST00000518630
  CDS Start-End: 218-571
attccagggttaagaaatggatgggtcactgagatctagcacccagttgtcctgggcttctgcttacggggttattgagatgatagaaggcccagtttttttgaagaagcaggatgctgatctaaacgtggaaaaagaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagat

SEQ ID NO: 135633 - DNA, 610 bp, Homo sapiens
  Payload ID: 6514
  Gene Symbol: FYN
  Gene Name: FYN proto-oncogene, Src family tyrosine kinase
  ENST ID: ENST00000517419
  CDS Start-End: 85-610
acagcggagagaataatcgaatgaaaactgaagctttctgctttattccttttctccttctcctttcagtcaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatcc

SEQ ID NO: 135634 - DNA, 569 bp, Homo sapiens
  Payload ID: 6514
  Gene Symbol: FYN
  Gene Name: FYN proto-oncogene, Src family tyrosine kinase
  ENST ID: ENST00000523574
  CDS Start-End: 151-569
aaaatgtgtcatctcatcctggggactgcccttggccactgctgaatctgttttgaaacctctttgcaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctcc

SEQ ID NO: 135635 - DNA, 1012 bp, Homo sapiens
  Payload ID: 6514
  Gene Symbol: FYN
  Gene Name: FYN proto-oncogene, Src family tyrosine kinase
  ENST ID: ENST00000523238
  CDS Start-End: 555-1012
agagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaa

SEQ ID NO: 135636 - DNA, 518 bp, Homo sapiens
  Payload ID: 6514
  Gene Symbol: FYN
  Gene Name: FYN proto-oncogene, Src family tyrosine kinase
  ENST ID: ENST00000487824
  CDS Start-End: 325-518
caggatgctgatctaaacgtggaaaaaagtgaacataagtcaagacagcagtgaggcactctggcgctgggacacagtgagaaattaagatttgctagtgctggttccagggcggcctgaactcttgtacttcagctcatgtcatgctgggacagatctgaaggaagatccatctccctcgggtttcttgatacttctgtgccttctgtctggcaagggcgtcagagccacgggaacttagaggaccagtcctgcctctgttgtagaagacatgtggtgtatataaagtttgtgatcgttggcggacattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttgg

SEQ ID NO: 135637 - DNA, 3023 bp, Homo sapiens
  Payload ID: 6514
  Gene Symbol: FYN
  Gene Name: FYN proto-oncogene, Src family tyrosine kinase
  Uniprot ID: P06241
  ENST ID: ENST00000538466
  CDS Start-End: 12-1616
gaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggaggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaa

SEQ ID NO: 135638 - DNA, 13230 bp, Homo sapiens
  Payload ID: 6515
  Gene Symbol: FRK
  Gene Name: fyn-related Src family tyrosine kinase
  Uniprot ID: P42685
  ENST ID: ENST00000606080
  CDS Start-End: 448-1965
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctggtaaaattaagcacactaaaccaagttatttttctttttaagagatacttacatttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctacagatcagagttttatttattttttattttttactttttattatagtttaagttctggggtgcatgtgcagaatgtgcagttttgttacataggtgtacaagtgccatggtggtttgctgcacccatcaacccgtcgtctacattaggcatttctcctagtgctgttcctcccctagccctccatcccctgacaggccccagtatgtgatgttcccctccttgtgtccatatgttctcattgttcagctcccacttatgagtgagaacatgctgtgtttggttttttgttcttgtgttagtttgttaagaatgatggtttccagctttatccatgtccctgtgaaggacatgaactcatccttttttatggctgcatagtattccatagtgtctatgtgccacattttctttatccagtctatcgttgatgggcatttgggttggttccaagtctttgctattgtgaatagtgccacaataaacatgcatgtgtctttatagcagaatgatttataagcctttaggtacatacccagtaatgggatcgctgagtcaaatggtatttctagttctagatccttgaggaattgctacactgtcctccacaatggttgaactaatttatactcccaccaacagagtaaaagtgtaaatgtgttcctatttctccacatcctctttggcatccaaaacagcatcctgttgtttcctgactttttaatgatcaccattctaactggtgtgagatggtatctcattgtggttttgatttggatttctctaatgatcagatgatgagctttttttcatatgtctgttggctgcataaatatcttcttttgaaatgtgtctgttcaaatccttcgcccactttttgatggggttgtttgtttttttcttttaaatttgtttatgttccttgtagattcttggtattagccctttgtcagatggatagcttgcaaaaattttctcccattctgtaggttgcctgttcactctgatgatagtttcttttgctgtctagaagctctttagtttaattagatcccatttctcaatttgggcttttgttgccattggtttttgtgttttagtcatgatgtcttttccaatgcctatgtcctgaatggtgttgcctaggttttcttctagggtttttatggttttaggtcttacatttaagtctttaatccatcttgagttaatttttgtataggtgtaaggaaggggtccagtttcagttttctgcatatggctagctagttttcccaacaccatttattaaatagggaatcctttccccattggttgtttttgtaaggtttgtcaaagatcagatggttgtagatgtgtggtgttatttctgaggcctctgttctgttctgttggtctagatatctgttttggtaccactaccatgctgttttgtttactgtagccttgtagtatagtttgaagtcaggtagcatgatgcctataactttgttctttttgcttagaattgtcttggctatgcgggctcttttttgattccatatgaagtttaaagtagttttttccaattctgtgaagaaagtcaatggtagtttgatggggatagcactgaatatataaattgccttgggcaatatggccattttcacgatattgattcttcctatccatgagcatggaatgtttttccatttatttgtgtcctctcttatttccttgagcagtggtttgtagttctccttgaagaggtcctttgcatcccttgtaagttgtaatcctagatatttcattctctttgtagcaattgtgaatgggagttcactcatgatttggctctctgtttgttattggtgtataggaatgtgtgtgatttttgcacattgattttgtatcctgagactttgctgaagttgcttatcagcttaaggagattttgggctgagatggtggggttccctatatatacaattcatatcatctgcaaacagagacaattttacttcctgttttcctatttgaataccctttatttctttctcttgcctgattgccctggccagaactttcaatactattttgaacaggagtggtgagagggggcatccttgtcttgtgccagctttcaaagggaatgcttccaggtttacccattcagtatgatattggctgtggttttgtcttaaatctgtcattttttttgagctacgttccatcaatacctagtttattgagagtttttagtatgaaggggtgttgaattttatcaaattttctgcatctattgagatcatcatgtggtttttgtcattggttctgtttatgtgatggattgtgtttattgatttgcgtatgttgaaccagccttgtgtctcagggatgaagccaacttgatcgtggtggataagctttttgatgtgctgctgcactcagtttgccagtattttattgaggatttttgcatggatgttcgtcagggatactggcctgaaattttctctctttttttttttttgttgtgtctctgccaggttttggtttcaggatgatgctggcctcataaaatgagttagggaggagtccctcttttcctattgtttggaatagtttcagaaagaatagtactagctttgtacctctttgtacctctggtagaattcggctgtgaatctatctggtcctggactttttttggttggtaggctattaattactgcctcaatttcagaacttgttattggtctatttagggattcatcttcttcctggtttagacttgggagggtgtatgtttgcaggaatttacccatttcttctagattttctagtttatttgcttagaggtatttatagtaatctctgatggtattttgtatttctgtgggatcagtggtgatctccgctttatcattttttattgtgtctatttgattctgctctcttttcttctttattagtctggctagcattctattttgttgatcttttcaaaaaatcagatcctggattcattgattttttgaaaggtttttcatgtctctatcaccttcagttctgttctgatcttagttatttcttgtcttctgctagcttttgaatttgtttgctcttgcttctctagtacttttaattgtgatattagggtatagattttagttctttcctgattcctcttgtgggcagttggtgctataaatttccctctacacactgctttaaatgtgtcccagagattctggtatgttgtgtttttgttctcattggtttcaatgaacaactttatttctaccttaattttattatttacccagtagtcattcaggagcaggttgttcagtttccaagtagttgttaggttttctgtcagttttaatcctgagttctaatttgattgcactgtggtcttagagactgtttgttatgacttccgttcttttgcatttgctgaggagtgttttacttccaattatgtgatcacttttagaataagtgcgatgaggtgctgagaagaatgtatattctgttgatttggggtagagaattctgtagatgtctgttaggtccacttggtccagagctgagttcaagttctgaatatctttgttaattttctgtctcatttatctgtctaatattgacagcaggctgttaaaatttcccactattattgtgtgggagtctaagtctctttgtagttctctaagaacttgctttatgaatctgggtgcttctgtattgggtgtatatatatttaggatagttagctattcttgttgcattgatctgtttaccattatgtaatgcccttctttgtctcttttgatctttgttgatttaaagtctgttttatcagagactaggattgcaacccctgctttttttttctgctttccgtttgcttcgtaaatattcctccatccctttatcttgagcctgtgtgtctctttgcatgtgagatgggtctcctgaatacagcacactgatgggtcttgagtctttatccaatttgccattctgtcttttacttggggcattcagcctgtttacatttaaggttagtattgttatgtgtgaatttgattctgtcatatgatgctagctggttattttgcccgaaagttgatgcaggttcttcgtatcctcgatgatctttacaatttggtatgtttttgcagtggctggtattgattgttcctctctatgtttagtgcttccttcaggagctcttttagggcaggcctggtggtaacaaaatctctcagcatttgcttgtctgtaaaggattttatttctccttcgcttatgaaactgagtttggttggatatgaaattctgggttgaaaattcttttctttaagaatgttgaatattggcccctactctattctggcttgtaaggtgtctgcagagagatcctctgttagtctgatgggcttccctttgtggctaacctgacctttctctctggctgcccttaacattttttccttcatttcaaccttggtgaatatgacgattatatgtcttggggttgctctgctcgaggagtatctttgtggcgttctctgtatttccttaatttgaatgttgacctgtcttgctaggttggggatgttctcctggataatatcctgaggagtgttttccaacttggttccattctccccgtcactttcaggtacaccaatcaaacgtagacttggtgttttcacataatcccatatttcttggaggctttgttagttccttttcactcttttttctctaatcttgtcttctcctttatttcattaagttgatcttcaatctttgatatcctttcttgtgctttatcgacttggctattgataattgtgtatgcttcatgaagttctcatgctgtatttttcagctccatcaggtcatttatgtgcttctctatacttgttattctagttagcaattcctctaatctttttacagtgttcttaacttccttgcattgggttagaacatgctcctttagcttggaggagtttgttattacccaccttctgaggcctacttctatccatccgtcaaactcattctccatccagttttattcccttgctggcaaggagttgtgatcctttggaggagaagaggcattctgtttttttgaattttcagctgttttgcgctggtttctcctcatcttcctggatttatctacttttggtctttgatcctgctgatgttcggatggggtctctgagtggacatactattcctttctgtttgttagttttccttctaagagttagtgccctctgctgcaggtctgctggagtttgctggaggtccactccagatgctgtttgccttggtgtcacgagtggaggctgcagaacagcaaagattgctgcctgttctttcctctggaagcttcgtcccagaggggcacccactggatgccagccagagctctcctgtatgaggtgtctgttggcccctactgggagatatctcccaatcaggataaacgagggtcagggacccacttgaggaggcagtctgactcttaccagagctcgagcactgtgctgggaaatccactactctcttcagagctgtccggcagagatatttaagtctgctgaagctgctcccatatccaccccttcccacaggtgctctgtcccagggagatggggttttatctattagtccctgactgccttttttttagagttgccctgcccagagaggaggaatctagagaggcagtctggccagagtggccttgctgagctgaggtggtgggctctacccaattcgaactcccaggcagctttgtttagactgtgagggtaaaatgcctactcaagcttcagcaatggcagacggccctcctccctccaagctcgagtgtcccaggtcgacctcagactgctgtgcttgcaatgaggatttcaagccagtgaatcttagcttgctgggctccgtgggggtgggacccgccaagctagaccacttggctccctggcttcagccccccttccaggggagtgaatggttctgccttgctggcattccaggcaccactggggtatggaaaataaaactcctgcagctagttcagtgtctgcccaaatggctgcccagttttgtgcttgacacccagggccccagtggcgtaggcaccggagggaatctcctggtctgcaggtttcaaagaccatgggaaaagtgcagtatctgggctggagtgcaccgttcctcaggtacagtccctcatggcttcccttgggtagaggaggtagttccctgaccccttgtgcttcctgggtgaggtgacaccccaccctgtttcagctggccctccatgggctgcacccactgtccaaccagtcccactgatatgaactgggtacctcagttggaaatgcagaaatcacccgccttctgcgttgatctcactgggagctgcagaccagagctgttcctatttggccatcttgccagcaatcagaccagagttttaaatggactacaaaataggtcaaactctatttcagaactagaggctaggaataatgtccaaacttggttatgaaagtttttttttttttttggtctggtaggataagagggtttttactcatcttaagtttgaattaaactttgtaacaaagttattgtttttttaaacaatgcatgtatcaaattatctgtctcattagataactaggtagacttttccaagatggtttcaaaatcaaatatatattcaaagatcttccagtgtaaagcaataggaatgaaacaagccatgagaaagcagaatattttgagtatattctcatgcctttctttaaaggagaagcgcctatctaaacagttacagaaacccaaattcaaagtagattaaacaagaagtaaatttgtaaactcttttaactgggagacaggaagtagggagggctccaggcacaatatcattagcagttcaatgtgaacgaagacccatgtcctttccaagcctccctctgccatcagcattgccctccttcccagggtcacagatggctatcaatggcaaaactggggttccgcgttctcttctcctcatctggcaagagaaaatgggaaatctctatcccaagcttggattaaaaattattttcatttttgtgttccagcaaacttgggtcctatgcccagccatggaccaaaaataggcttaatgtgaatgttatgtgctgattggattaaaataagttctgactctgaatctgggaatgtggtcaccttcctcagagacaagttgagaggttggcttatctgaataaaagcagagaatatgagatgctggagaggtgttcattaaggagaacattccctgaggtgaattaacggttagaattatctatctctgtatttatctatccacccatctatcatcatcatcacctcatctccctcctttctctctctctaaatatatacatgcgggtatgttgagtgtgtatatatttatttttttgtgtgtttatatggtgtgtgtgtgtgtgtattccaggcagatgtgtgcatatatacccaaactttcctgatgaccttgaaattaaatgggtcatgtgaagctaaagattatagaaccccttgattcctttataaacagtatttctaagataagatcaacactaatctttcaaattagttgactgtgtatagaacaacttgtttatttaaagtcatctagtctaatgcaatcaaggagtaaattataaataaccagttagcataaatggaaagaaaatagttccttttctttgaattcatttcatgtttaatttttcttgcgcacatatagaaatgaatagaaatattcccatttcaatatgcaaattcagccactatatagtttgtttctttttggtagctaataataataaatttttaagtaagatctgattttgaaatatgaaaagaagtttatcctttcctgttttaataccacctgatacccgtttaacttactgtgtttgattcttggggacatttatgttcaaggttctgtcaaagcaatctattattcttgtttttacctgatggatcatggagaaaaataatggattcagttatgagaaacagtaatagatttttttaactgccataaatttctctccctgtattaaataaaaggatcaggaaaagataagttgaattttcctacaatgagccagctcttcttaaatttacctcccataaattgtagcaaagcacttttcatataatgttttatttatgtaattcagttatttggagatggtggtgagggatgtgagtacatcatttcatgttgtatttcaaatctcttttgacagaaaccctaagaatttgcaataaagaaaattcaatgttccattaagtttttctttttctttttttttaaaaagagggtaaggaaggaaataagggaatagatttaagttacctaaggtcaaaagaggcacagggtagactctgaatagttgtggaacctgaatattttgtcatcaaaaacaaagttaaagtcagagtgaccaggaatctgcaaactggctgtgggaatgggttgacttaaaagacagacaaagaactagcctgtggggtaacatcaggctaggctcaccctcagcttctacccacaatatctgtatgatgaccatgtggatctaatgaaccaggaggggcccaaactcttccgactctgtggaggcctaaaggaaactgttgccattggaaggatgccataccactacccagctggagcttcctgaaggaagcagagcccagctggtgttccatggtttgttaagcatatgccatacctacaatcacttttttcatggtctggttgagcatatgatttctgaaccaaatagcctttctggtattgtgtcattggtgactcattatgattctttaaaaagacacattatgtgagctagaatggtgatgatttgggtaccttattcaaattgcatcatcatttaattcaagagaaaggccattcttaaagtaaaagtaaatgaggtttgtacacctgggtattggaattgccagtgggctgatctgacaatgtttgattcttgttttttctggaattattatgtagaagattcagtctataatcttcaacatgatgcaaatattcagtgtcataggatcaaaaaaatgctggaaagtatctaaaaatcttttaaattcatatcttaattttcagtgttatcctcttactgcctacattcccccactaaactcttagatttttctctgcttttgttaagaaagtgatgttagtaggcctctcaagttatttatgaaatttagaaatatactggagaacaaagtagtatataaaccctgaatttcaaaagccttaacaagtttagcttcaatctacattcagatgacactatctacagagatgttataagattaaattacaagaaaagagatgcccaattatttccatttactcttcttgcctaggtagttaatttatctattattcatttgaagcaacagacgtcaatgtaacatctttttcattttcatggagaataatcagcttttccagaaaagggtgctatatctcaaacacacctcaagtgtccagttggaagtattaccatgcagaggattcaagtcatattacctaataaccagaagttgtatgttgggaaaaagtggttaaaagcaactaaaactgccctgtttggaagaaactaaatattgctttataatgattttctgatattttagaatagaggcttcaattatactatttgtgaaaaagaaaactgcttggtattaaccaagttacatttaatttttatggtccacaaaatttcagagtagaaatatatcatagcttttaatcaattttcaaaatctatatttaattattgattcaaaaaataagaaataaaatcaattagccagatttgtatactttaaagctaccacagtgagatttttctcttaaaaacatgcatgtttttatattgtattctttaatatttatattgtacagttacatgtgacacatattacatatgactaatttatatgtagcaacagggattaaagaagacctcttttaattgtaccacttgttataatgctattatttacccagattcaaatgtaactacttacaatttttaaacatttttatttctgtattctttaaaatattaaggcaatggtttttcttgaaattatattttgccctatgtattctatttttattcacactggatttattatgataattatatcaaagtgattatttttaccctgacttttaaaagtcaactgtttcagaagtcaagttgattgtggatctaaaatataaattcaatgtgttcatagca

SEQ ID NO: 135639 - DNA, 8504 bp, Homo sapiens
  Payload ID: 6516
  Gene Symbol: FYCO1
  Gene Name: FYVE and coiled-coil domain containing 1
  Uniprot ID: Q9BQS8
  ENST ID: ENST00000296137
  CDS Start-End: 207-4643
gtgtgcgcgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgctttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacattt

SEQ ID NO: 135640 - DNA, 4317 bp, Homo sapiens
  Payload ID: 6516
  Gene Symbol: FYCO1
  Gene Name: FYVE and coiled-coil domain containing 1
  ENST ID: ENST00000433878
  CDS Start-End: 1-803
tgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacattt

SEQ ID NO: 135641 - DNA, 1072 bp, Homo sapiens
  Payload ID: 6516
  Gene Symbol: FYCO1
  Gene Name: FYVE and coiled-coil domain containing 1
  ENST ID: ENST00000438446
  CDS Start-End: 443-892
atagtgtgtcatcctcacagcctgggcttgttttgttcccaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactctt

SEQ ID NO: 135642 - DNA, 8578 bp, Homo sapiens
  Payload ID: 6516
  Gene Symbol: FYCO1
  Gene Name: FYVE and coiled-coil domain containing 1
  Uniprot ID: Q9BQS8
  ENST ID: ENST00000535325
  CDS Start-End: 216-4712
accctcttggtgtgcgcgtcatggccgtcagcaccgcgttcccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaagatgctgtgacagaactaagcaaagaatttcaggaagcaggggaacccatcacggatgacagcaccagcttgcataaattttcttataaacttgagtatctcctgcaatttgatcagaaagagaaggccaccctcctgggcaacaagaaggactactgggattacttctgtgcctgcctggccaaggtgaaaggagccaatgatgggatccgctttgtcaagtctatctcagagctccgaacatccttggggaaaggaagagcatttattcgctactccttggtgcaccagaggttggcagacaccttacagcagtgcttcatgaacaccaaagtgaccagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggaggacgctgaccactggctcttctgcttacctgtggaaaccccctagccgcagctccagcatgagcagcttggtgagcagctacctgcagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaagaatgctggtgaagagtgcaagagcctcaggggccagcttgaggagcaaggccggcagctgcaggctgctgaggaagctgtggagaagctgaaggccacccaagcagacatgggagagaagctgagctgcactagcaaccatcttgcagagtgccaggcggccatgctgaggaaggacaaggagggggctgccctgcgtgaagacctagaaaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacaggcgtctgtcggggccagcaagggtctgggaaacctgctctgtgaatcatctgcttgcagggatactacatcaacctcgctaacgcctgaggacactgaagacatgcccgtggggcaggattcggaaatctgcctgctgaagtctggagaactgatgatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtcctcattcccacgacccgatgcaactcccacaaggagaacatccagggccagctcaaggttcgcacacccggcatctacatgctcatcttcgacaataccttctcaaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacatttagaca

SEQ ID NO: 135643 - DNA, 4275 bp, Homo sapiens
  Payload ID: 6517
  Gene Symbol: FGD1
  Gene Name: FYVE, RhoGEF and PH domain containing 1
  Uniprot ID: P98174
  ENST ID: ENST00000375135
  CDS Start-End: 735-3620
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgcccccggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctgggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacaggtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggagttgactgtgcagcaaaaggtgtttcacattgccaatgagctcctgcaaactgagaaggcctacgtttccaggctccatctcctggatcaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatgggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaaagtctctggagctgatcgccacagcagcagagcactcgaatgctgccatccgcaaaatggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactattcaacgaccgcctcctttactgcgtgcccaggctgcggctccttggccagaagtttagcgtgcgggcacgcattgatgtagatggcatggagctaaaggagagctccaacctcaatctgcctcgaaccttcctggtgtcaggaaagcagcgctccctcgagctccaggccaggactgaggaggagaagaaagactgggtccaggccatcaactccaccctcctgaagcatgaacagacgctggagactttcaaactgttgaactcaacaaacagggaagatgaagacaccccacccaactctccaaacgtggatcttgggaagcgggcacctacgcccatccgggaaaaggaagtcaccatgtgcatgcgctgccaggagcccttcaattctatcaccaaacgcaggcaccactgcaaggcctgcgggcatgtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaa

SEQ ID NO: 135644 - DNA, 3046 bp, Homo sapiens
  Payload ID: 6518
  Gene Symbol: FGD2
  Gene Name: FYVE, RhoGEF and PH domain containing 2
  Uniprot ID: Q7Z6J4
  ENST ID: ENST00000274963
  CDS Start-End: 172-2139
ctttcttcactctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtgcgggagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaattttaaaaatgtaaaaaacaatgcctgtactgaagtaccaccaccgatttaaatgggctgagttgggggaggcatggggtctttttttttttttttttgagacagagtcttactctgtttcccaggctggagtgcacaaacatggctcactacagcctcgctctcccgggctccagtgatcctcccgcctcagcctcccaagtagctgggattataggtgtgtgccactgtgccaagctaatttttttattttttgtagagatgggatttcaccatgttactcaggctggtctcaaactcccagcctcaagcgatgctcccacctccacctcccaaagtgctgggattacaggcgtgagccaccatacctggcgcatgcatattttttaagagtacccactggagtctaatatatagcctgggttacctgggatgaagaataaagagagcaaactaccacaaccaatggttgagcccctgtcaagtgccagtcatgatagtagtaataataataataaacatctattggaccaggc

SEQ ID NO: 135645 - DNA, 2197 bp, Homo sapiens
  Payload ID: 6518
  Gene Symbol: FGD2
  Gene Name: FYVE, RhoGEF and PH domain containing 2
  ENST ID: ENST00000373535
  CDS Start-End: 164-472
actctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgggtgatccaggtgggcgcccagttccaggtgaggacccgcatcgatgtggccgggatgaaggtgcgggagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcc

SEQ ID NO: 135646 - DNA, 541 bp, Homo sapiens
  Payload ID: 6518
  Gene Symbol: FGD2
  Gene Name: FYVE, RhoGEF and PH domain containing 2
  ENST ID: ENST00000497659
  CDS Start-End: 164-478
actctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggtgcctgagggctgaggagccagagaagaagatcgtccaggagctgctggagacagagcaggcctatgtggcgcgcct

SEQ ID NO: 135647 - DNA, 3303 bp, Homo sapiens
  Payload ID: 6519
  Gene Symbol: FGD3
  Gene Name: FYVE, RhoGEF and PH domain containing 3
  Uniprot ID: Q5JSP0
  ENST ID: ENST00000337352
  CDS Start-End: 483-2660
gagcactcaggagactgtgtgtggtgggggtgctccaccatagagctggtcggcatccacagccaccaggacgctgccagagcccaggcctgcgccacgccctgcccagaggcacacctgcctgctcaaggcaaccagggcaggctcaaggcagccagggccagctcactgtgtgcctgtcactgtgtgaagcctgcttcttctttatttcgcttagcaagtgaggcaggagcatgtaaagctgctggcagaggaatatctaatttacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 135648 - DNA, 3321 bp, Homo sapiens
  Payload ID: 6519
  Gene Symbol: FGD3
  Gene Name: FYVE, RhoGEF and PH domain containing 3
  Uniprot ID: Q5JSP0
  ENST ID: ENST00000375482
  CDS Start-End: 497-2674
tgcctgtgggtgccgcggaccttcggggcgggccagggaggcgggaccgctcctcagaaccccaggggcttcagtcctgggctgattggcgcgggaagcacagcccggccctccaggtccccaaggagaccccagcctcctgctgcccactgtgagcgacctccccggggctcctctggaagcggctccggcaagtatcgagtttgcctgtgcggagctgggggagcctccggctttcctgtttgctttgttaattattttcgtccccagaggaaggcgtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 135649 - DNA, 3432 bp, Homo sapiens
  Payload ID: 6519
  Gene Symbol: FGD3
  Gene Name: FYVE, RhoGEF and PH domain containing 3
  Uniprot ID: Q5JSP0
  ENST ID: ENST00000416701
  CDS Start-End: 611-2785
attccctgctgggcccctcctccctgaagatctacacagcagatctactcacaaaagtccacccagcagaagcaggaggatggtggttgtgggtcctctgtgagcagccctgttaacctttaaaccagcacggccgccgcagctgtgagcctagcacctgatcagtggagagctgtggattgcatgtttgtttgccattgcccccgccaccctgcaagttgcaccttctagaatcagcaagccaagctcctctcacccagcgtaatgatgcggaaatgcaaatgcaccatcatgttgtgacccatattgcgaaaattagaaaaaaggaagttgtgtttcgctattgcacgaagttcagcccagaggagaaactcgctcgccttcagaagacagtacctcctaaatggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 135650 - DNA, 4697 bp, Homo sapiens
  Payload ID: 6519
  Gene Symbol: FGD3
  Gene Name: FYVE, RhoGEF and PH domain containing 3
  Uniprot ID: Q5JSP0
  ENST ID: ENST00000467786
  CDS Start-End: 206-2110
ggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcgtccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacaggaagaaaaaggtccctggagctgcagacgcggacagaggaagagaagaaagaatggattcagatcatccaggccaccatcgagaagcacaaacagaacagcgaaaccttcaaggcttttggtggcgccttcagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctccagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgacttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacacttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagcagtg

SEQ ID NO: 135651 - DNA, 2691 bp, Homo sapiens
  Payload ID: 6520
  Gene Symbol: FGD4
  Gene Name: FYVE, RhoGEF and PH domain containing 4
  ENST ID: ENST00000395740
  CDS Start-End: 415-1122
ctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggtatctaaaccacatctgtctgaagggacagatgcccttgggggcaaggggaagcgagtggacagcggactcaaaatctgtagaacaagagttcaggcagtttcactgtttcattaaaattgaaaaataatgag

SEQ ID NO: 135652 - DNA, 8242 bp, Homo sapiens
  Payload ID: 6520
  Gene Symbol: FGD4
  Gene Name: FYVE, RhoGEF and PH domain containing 4
  Uniprot ID: Q96M96
  ENST ID: ENST00000427716
  CDS Start-End: 425-2725
attatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtgaaaactggagcattttttgagctattccttgaatatgtgcttttttgtcttgaagaaatggtgtatcaattgattctgtcaccgtcaggttagaatgagcacttccatttaagaaatcctttcatgtcttcttctctttcacatgtaggacctggaacagtttgaaagatatacctccatgttgccaaaatagatccatggtgaaaaatacagggacagttgaggctattgtattaacttatttaatttagtttataaatctctagctgcataaatgatgtctgttcttttaaaacaaaagaaaaaggacaaattgttggtgttcagatttccgatttataaagaaaagataacttgtttttgtagaaatactcctaagaatgtcttaagtatatagcaattatgtatatatagtattaaatatatatattatacatgcttttaggttcacattcatctctaatttattttttaaatataaagcatggtttatcgtggaattgagcaatgttctaaactgaagaaatgttttggtgatttatgttttgctgattggcatttgagggtattgatatttttataataagcggtaatttatgtggcatgggatatatttgtgaattccaacagtacttttaaagtaccattttttgtttctgtgcctatttaaaacagtgcctctcttagaaggtgctattaatataagatgagggttcagttaatgcttcagtcttgattattctaagattaaagtgcattttggtcactgggacagtcaaagtcatacaggttattttaccgtttacaatcctataattattgcagtagttaacatcagcatgtacaaacattttcaccaaaacccaaactttatgagacacctgaccttttacagaactaggatatgtggaaaccacatttatcgtaatgtttttcttttccgtaagataatcgagcatggttaaataaggtctctatataatgaacacttaagataactgtatgggccttttcctttgtcggaatgaaacaaaatccacatgtgataacctatgtttggggtgggggctggtcacatgattccttgtcatgaaggctgctcttcactcttttgtacttgtgattaaaatctcacactaagtttactatttaacttaatcctttttctcaaattaaacctttttttatactgtcataccccaaacattgtcactttttaatgtaccagtctgctagaaatctacaagaatgatcccactatctttagtatgtaaggattacaccttagatatagaatagaatttgagactgccacacatttattcaggccttgttactttaagaaatatcttattttttccaccccaaaggagcaagtgaaccaattattgctgacataataggttcccttcctccataaaaggattatcagccatgatcattaacattaaaccaaatagatggagccaaaaagagataaaagtagcttcttaggccctattaaatcagggaaagactagaagaaaatttacattgcttctcttttttaatggccagcggggtatgtgtgtgatgtatactcagagtggttttttggaaaattaaactgtagctatagatgatgctttggttttcttaatctcaagaaaagagaagcaatggaaatacagaatgattaactggggaagaggacttttgtaagtgtgactagaacaatggtaatgtatgggccaatgggaagatttataagtcagattatttttgaaaactatttttaaaagcaagaagactacactttccctaccaaaacagaagtaacatggacacacttaagttttggctcaataaatatcaatgttatttaacttagatcattgaaagaatactcatgtaaagataatgtttattatcatgctcttaacagtcattatctttaattttttaaatgagaagcattaatactagaagagaatttctggttatccggtcaccatattcactttccaccccacattcttcagctaaacgcaaagagaagcagtgaaacagccttacccgcttctctcttattaaagaatcactgatgtttttactcaatgaaaggtaaagtaatacccttagccatttattaaacaattcaaccaagagacctcaaagtgtgattgatgataagaataatcaatgccttttcccttccaacatacttgagcagtcatgacaacctaaaaatatcattggttgctttcccattaaaaccaacgttccctgtgggtcttaattctttattttcactcatttggtgctttccaagtcatcttttctttaaagtgcccttcctccaaactttaaaaagtacttccttgacaaaatttctattcattataaaacatttcaatattttaagcttaaattttgcttttgctgaaagcctaccatttggcgtgttaagtatgaaatatagtgcagacttttatcttggttttaagtggggctcaataaaaaacaccagccacttttgtaataatggcatcacagtgtcatcatgtatgcaagcaataaaactctttagggtatggttttatactgaaaatttaatatgaaggccccttcccacaagaatatagataattattaactttctagatgtgatacggtaattcgaattgcagagtataaggaagggaaatgggaaggggcatcattccttggattttaaataactatcaagaacatttttactttaacaaagaaaatggatagaaaaagcacattttgttttccctgaagtttaatttgacatcaggtttgtgtacttatcttcactaggtgacttaacttaccccaatttttttaaaaattattaaactttttacagaaactaaccttttaaatgtaccctttccccatatatatatacgcacacgtttggattttttttttttaagaacacttgttctagttataaatatataaagaaaacgataaagtttgtggtactgcagggttgttaaagattctttgatgccttctaaaaacttttgtcaaaaatacttttgagttcacaattctgttttacttttccttgtccttactttttggaaacagggtggttgcttttatttgttttctggttatattcaaagccttaagttcttaatctgagcatattgtctgtgataaatttctgatgatctttctggactagatacaacctgagtagcaagcaccaaccggagcaagtaaacttctagggaacaagcgtcttgggttttataggtatctttgctataatgcagaatagattaatgaagatttcctatatcatatgatatttgtgttagtgggtctaagattaagcacatgatatttataagctaaaattaactcaaaagtcaagaatgtcttaatgttttcattcttaaattttgtattctccaagaatgtattagtatatgaactgtggccaaccagttcctattcttcagactgtattgacatctgtagtggatcatgttgcttcttcattcttaccaattttattagaatcaaacttcttgttatttgcatactattatctactatagattctcagctttagaaaatgactatgatacataaagaccactaggtcaacttaaaaaaccctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaatctgaagtcaatcatggtcttctactttctggactgagcatttggcagaatgcagtatcttttcctgtattttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacattttaaaataagcataggccgggcatagtggctcatgcctgtaatcccagcccttgggaggccgaggtgggcagatcacttcaggtcaggagtttgagaccagcctggccaacatggtgaaaccctgtctctactaaataaaaataaaacaaaataagtgtatctgggccaggcacggtagcccatgcctgtaatcccagcactttgggaggccgaggagttcgagaccagcctggccaacatggcaaaaccctgtctctacaaaaattagccaggtgtggtggcacatgcctgtaatcccagctactcgggaggttgaggcaggagaattgcttgaacccgggagacagaggttgcagtgagccgagattgcaccactgcactccggcctgggtgacagagcaagacttcgactcaaaaaataaaataagcgtatctggatttttcttttgaattcttgactgataagtttgagaatgtatgtttttggaattttacagttgactcaagtgtgaaagtatacacaagtaatttttcttttctagctatgtgaatgtaaaatacttgcagataatgtatatattgtgtaatatatgtatatttggtcataaaagcagataattggaaacattgtaaaattaagcactttaattcctattaaatattaaacatttgtatcttgtaaataaacacatccttaaattaa

SEQ ID NO: 135653 - DNA, 2924 bp, Homo sapiens
  Payload ID: 6520
  Gene Symbol: FGD4
  Gene Name: FYVE, RhoGEF and PH domain containing 4
  ENST ID: ENST00000531134
  CDS Start-End: 163-2718
agttagttctttatcatgttgaacactagatgtgtatgtgtctagtgtctaaatacagaatgcctatagtttctaccaacaaattatggatccaaatccttgctccagaagcaggaaataggttaatcagaagattgctggatgttatgaaaagaatcttttatggggggctgcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtg

SEQ ID NO: 135654 - DNA, 2925 bp, Homo sapiens
  Payload ID: 6520
  Gene Symbol: FGD4
  Gene Name: FYVE, RhoGEF and PH domain containing 4
  ENST ID: ENST00000525053
  CDS Start-End: 85-2721
agtgcattggtctgagctcctggcagatcctgtgtaatcttcagcctccctgaagctttacagccaggagtgagattttatcacatgaactttaaaagagtaaagccaaatatctttttattaaaccagagtagattaattatcagtatatgtgaaatcatgtccactgatcaaggcagcagtacctgtccaaagatcgctttagttccaccttgctccacaagcagcacaaccacactggttggtgagaatgtatctgaagaagaggctcagggaataaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatacagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagacagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatg

SEQ ID NO: 135655 - DNA, 2349 bp, Homo sapiens
  Payload ID: 6520
  Gene Symbol: FGD4
  Gene Name: FYVE, RhoGEF and PH domain containing 4
  ENST ID: ENST00000494977
  CDS Start-End: 1-197
gggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcagaaaatagagtggaggtgaatttagaaaattaacaaccatctggacattatgaaggaatagacctccttctgcctacatgtaacagaatggcaattaagaggtattttattgcaaactgttggaagaagcaaaccgaggctcgtttccagcagagatggtgaataaaatcttttctaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaagagacgaggttttgccatgctgcccaggctgatctcgaactcctgagctcaagcgatctgcctgcctcggtctcccaaagtgctgggattacaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagttccgcatggctggggaggcctcagaaaacgtacaatcatggcagaaggggaagaggcacatcttacatggtggcaagcgagagtgagcaagtgtatgaaggaagaactgtcagacacttacaaaaccatcagatctcatgagaactcacgatcacgagaacagcatgggggacactgcccccatgatccagttacctcctatcagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacagctaaacgcaaagagaagcagtgaaacagccttacccgcttctctcttattaaagaatcactgatgtttttactcaatgaaagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgct
